US011053305B2

(12) United States Patent
Curtis et al.

(10) Patent No.: US 11,053,305 B2
(45) Date of Patent: Jul. 6, 2021

(54) FUSION PROTEIN CONSTRUCTS COMPRISING ANTI-C3D ANTIBODY AND CR1 POLYPEPTIDE

(71) Applicant: Q32 Bio Inc., Cambridge, MA (US)

(72) Inventors: Michael Steven Curtis, Waltham, MA (US); Michael Storek, Cambridge, MA (US); Shelia Marie Violette, Lexington, MA (US); Susan L. Kalled, Concord, MA (US); Kelly C. Fahnoe, Waltham, MA (US); Cheng Ran Huang, Belmont, MA (US); Ellen Garber Stark, Cambridge, MA (US); Frederick Robbins Taylor, Milton, MA (US); Justin Andrew Caravella, Cambridge, MA (US); Vernon Michael Holers, Denver, CO (US)

(73) Assignee: Q32 Bio Inc., Cambridge, MA (US)

( * ) Notice: Subject to any disclaimer, the term of this patent is extended or adjusted under 35 U.S.C. 154(b) by 0 days.

(21) Appl. No.: 16/752,074

(22) Filed: Jan. 24, 2020

(65) Prior Publication Data

US 2020/0181249 A1    Jun. 11, 2020

Related U.S. Application Data

(63) Continuation of application No. PCT/US2019/065741, filed on Dec. 11, 2019.

(60) Provisional application No. 62/778,014, filed on Dec. 11, 2018.

(51) Int. Cl.

| C07K 16/18 | (2006.01) |
|---|---|
| A61P 13/12 | (2006.01) |
| A61K 38/17 | (2006.01) |
| C07K 14/47 | (2006.01) |

(52) U.S. Cl.
CPC .......... *C07K 16/18* (2013.01); *A61K 38/1725* (2013.01); *A61P 13/12* (2018.01); *C07K 14/472* (2013.01); *C07K 2317/51* (2013.01); *C07K 2317/565* (2013.01); *C07K 2319/00* (2013.01)

(58) Field of Classification Search
None
See application file for complete search history.

(56) References Cited

U.S. PATENT DOCUMENTS

| 5,679,345 | A | 10/1997 | Sanfilippo et al. |
|---|---|---|---|
| 6,333,034 | B1 | 12/2001 | Gupta-Bansal et al. |
| 6,355,245 | B1 | 3/2002 | Evans et al. |
| 6,458,360 | B1 | 10/2002 | Fearon et al. |
| 7,439,331 | B2 | 10/2008 | Fung et al. |
| 7,999,082 | B2 | 8/2011 | Holers et al. |
| 8,937,046 | B2 | 1/2015 | Thurman et al. |
| 9,815,890 | B2 | 11/2017 | Holers et al. |
| 2001/0018051 | A1 | 8/2001 | White et al. |
| 2003/0143223 | A1 | 7/2003 | Cabezas et al. |
| 2004/0180046 | A1 | 9/2004 | Himawan |
| 2005/0175608 | A1 | 8/2005 | Tamura et al. |
| 2005/0260198 | A1 | 11/2005 | Holers et al. |
| 2006/0105952 | A1 | 5/2006 | Allison et al. |
| 2007/0065433 | A1 | 3/2007 | Mollnes et al. |
| 2007/0154897 | A1 | 7/2007 | Yen et al. |
| 2008/0118506 | A1 | 5/2008 | An et al. |
| 2009/0017031 | A1 | 1/2009 | Fung |
| 2011/0014270 | A1 | 1/2011 | Holers et al. |
| 2012/0122107 | A1 | 5/2012 | Thiel et al. |
| 2013/0078245 | A1 | 3/2013 | Holers et al. |
| 2013/0171236 | A1 | 7/2013 | Holers et al. |
| 2013/0273052 | A1 | 10/2013 | Gies et al. |
| 2013/0344073 | A1 | 12/2013 | Schwaeble et al. |
| 2014/0056895 | A1* | 2/2014 | Baurin ................ C07K 16/244 424/136.1 |
| 2015/0079084 | A1* | 3/2015 | Her ...................... C12N 9/1205 424/134.1 |
| 2015/0139899 | A1 | 5/2015 | Bansal |
| 2015/0147323 | A1 | 5/2015 | Thurman et al. |
| 2015/0182588 | A1 | 7/2015 | Kahvejian et al. |
| 2015/0306254 | A1* | 10/2015 | Holers ............... A61K 49/0058 424/9.6 |
| 2016/0083469 | A1 | 3/2016 | Rohrer et al. |
| 2016/0333082 | A1 | 11/2016 | Wiestner et al. |
| 2017/0209549 | A1 | 7/2017 | Holers et al. |
| 2018/0271910 | A1 | 9/2018 | Mata-Fink et al. |
| 2018/0371069 | A1 | 12/2018 | Thurman et al. |
| 2019/0002541 | A1 | 1/2019 | Thurman et al. |
| 2021/0009669 | A1 | 1/2021 | Curtis et al. |

FOREIGN PATENT DOCUMENTS

| WO | WO-9802454 | A2 | 1/1998 |
|---|---|---|---|
| WO | WO-2004075837 | A2 | 9/2004 |
| WO | WO-2004106384 | A1 | 12/2004 |
| WO | WO-2005027965 | A1 | 3/2005 |
| WO | WO-2005063815 | A2 | 7/2005 |
| WO | WO-2007112403 | A2 | 10/2007 |
| WO | WO-2008154251 | A2 | 12/2008 |
| WO | WO-2009029669 | A1 | 3/2009 |
| WO | WO-2009056631 | A2 | 5/2009 |
| WO | WO-2010015608 | A1 | 2/2010 |

(Continued)

OTHER PUBLICATIONS

International Search Report and Written Opinion dated Jun. 16, 2020 for International Application Serial No. PCT/US19/65741, (19 pages).

(Continued)

*Primary Examiner* — Phillip Gambel
(74) *Attorney, Agent, or Firm* — McCarter & English, LLP; Steven G. Davis; Yu Lu

(57) ABSTRACT

Provided herein are fusion protein constructs that can bind a complement-associated antigen, comprising a targeting moiety and a complement modulator protein, or a fragment thereof or a variant thereof. The targeting moiety is an antibody or an antigen binding fragment thereof, in some examples. Further provided are methods of using the fusion protein constructs, for example, in treating complement mediation conditions.

35 Claims, 35 Drawing Sheets

Specification includes a Sequence Listing.

(56) References Cited

FOREIGN PATENT DOCUMENTS

| WO | WO-2010034015 A2 | 3/2010 |
| WO | WO-2010136311 A2 | 12/2010 |
| WO | WO-2011047346 A1 | 4/2011 |
| WO | WO-2011057158 A1 | 5/2011 |
| WO | WO-2011163412 A1 | 12/2011 |
| WO | WO-2012044893 A1 | 4/2012 |
| WO | WO-2014116880 A1 | 7/2014 |
| WO | WO-2015187992 A2 | 12/2015 |

OTHER PUBLICATIONS

Alexander, et al. Administration of the soluble complement inhibitor, Crry-Ig, reduces inflammation and aquaporin 4 expression in lupus cerebritis. Biochim Biophys Acta. Nov. 20, 2003;1639(3):169-76.

Atkinson, C. et al. "Targeted complement inhibition by C3d recognition ameliorates tissue injury without apparent increase in susceptibility to infection," The Journal of Clinical Investigation 115.9 (2005): 2444-2453.

Atkinson et al. "Targeted Complement Inhibitors Protect against Posttransplant Cardiac Ischemia and Reperfusion Injury and Reveal an Important Role for the Alternative Pathway of Complement Activation", Journal of Immunology, 185 (2010): 7007-701.

Atkinson, Carl et al., "Targeting complement inhibition to post-ischemic neoepitopes exposed in transplanted hearts", Molecular Immunology, 2010, vol. 47, p. 2266, abstract No. 29.

Degn, et al. Co-complexes of MASP-1 and MASP-2 associated with the soluble pattern-recognition molecules drive lectin pathway activation in a manner inhibitable by MAp44. J Immunol. Aug. 1, 2013;191(3):1334-45.

Degn, et al. MAp44, a human protein associated with pattern recognition molecules of the complement system and regulating the lectin pathway of complement activation. J Immunol. Dec. 1, 2009;183(11):7371-8.

Elvington, A. et al. "Pathogenic Natural Antibodies Propagate Cerebral Injury Following Ischemic Stroke in Mice". J. Immunol. 188, (2012): 1460-1468.

Fleming et al. "Mice Deficient in Complement Receptors 1 and 2 Lack a Tissue Injury-Inducing Subset of the Natural Antibody Repertoire", J. Immunol. 169, 2002: 2126-2133.

Fodor, et al. A novel bifunctional chimeric complement inhibitor that regulates C3 convertase and formation of the membrane attack complex.J Immunol. Nov. 1, 1995;155(9):4135-8.

Haas, et al. Blockade of self-reactive IgM significantly reduces injury in a murine model of acute myocardial infarction. Cardiovasc Res. Sep. 1, 2010; 87(4): 618-627.

Huang et al., "A Novel Targeted Inhibitor of the Alternative Pathway of Complement and Its Therapeutic Application in Ischemia/Reperfusion Injury", The Journal of Immunology, vol. 181, No. 11, 8068-8076, 2008.

Kulik, L. et al. "Pathogenic Natural Antibodies Recognizing Annexin IV Are Required to Develop Intestinal Ischemia Reperfusion Injury", J. Immunol. 182, (2009): 5363-5373.

Linton, et al. Therapeutic efficacy of a novel membrane-targeted complement regulator in antigen-induced arthritis in the rat. Arthritis Rheum. Nov. 2000;43(11):2590-7.

Patel, et al. "A novel therapy for myocardial ischemia-reperfusion",Drugs Today (Bare) 41.3, (2005): 165-70.

Pickering, M.C. et al., "Uncontrolled C3 activation causes membranoproliferative glomerulonephritis in mice deficient in complement factor H," Nature Genetics 31, (Aug. 2002): 424-428.

Qiao, Fei et al., "Role of pathogenic natural antibodies and complement in murine model of spinal cord injury (P4051)." J Immunol. May 1, 2013; Supplement 131.26

Quigg, et al. Blockade of antibody-induced glomerulonephritis with Crry-Ig, a soluble murine complement inhibitor. J Immunol. May 1, 1998;160(9):4553-60.

Rohrer, et al. A Targeted Inhibitor of the Alternative Complement Pathway Reduces Angiogenesis in a Mouse Model of Age-Related Macular Degeneration. Invest Ophthalmol Vis Sci. Jul. 2009; 50(7): 3056-3064.

Rohrer et al., "A Targeted Inhibitor of the Complement Alternative Pathway Reduces RPE Injury and Angiogenesis in Models of Age-Related Macular Degeneration", Advances in Experimental Medicine and Biology, vol. 703, 137-149, 2010.

Rohrer, et al. "Systemic Human CR2-Targeted Complement Alternative Pathway Inhibitor Ameliorates Mouse Laser-Induced Choroidal Neovascularization",Journal of Ocular Pharmacology and Therapeutics 28.4, (2012): 402-9.

Smith, et al. Membrane-targeted complement inhibitors. Mol Immunol. Aug. 2001;38(2-3):249-5

Smith, et al., "New Approaches to the Treatment of Dense Deposit Disease" Journal of the American Society of Nephrology 18, (2007): 2447-2456.

Smith, et al. Targeting anticomplement agents. Biochem Soc Trans. Nov. 2002;30(Pt 6):1037-41.

Song, H. et al., "Complement receptor 2-mediated targeting of complement inhibitors to sites of complement activation," The Journal of Clinical investigation 111.12, (Jun. 2003): 1875-1885.

Yuxiang Huang et al., "A Novel Targeted Inhibitor of the Alternative Pathway of Complement and Its Therapeutic Application in lschemia/Reperfusion Injury", The Journal of Immunology, 2008, 181:8068-8076.

Zhang, et al. Targeting of functional antibody-CD59 fusion proteins to a cell surface. J Clin Invest. Jan. 1, 1999; 103(1): 55-61.

Zhou et al., "Predominant role for C5b-9 in renal ischemial reperfusion injury" The Journal of Clinical Investifation 105.10, (May 2000): 1363-1371.

\* cited by examiner

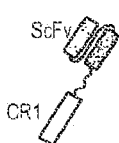  
FIG. 26A  FIG. 26B  FIG. 26C
 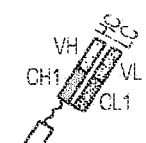 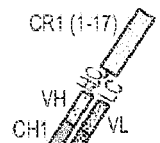 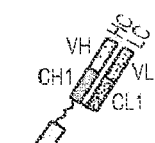
FIG. 26D  FIG. 26E  FIG. 26F  FIG. 26G
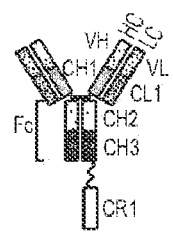 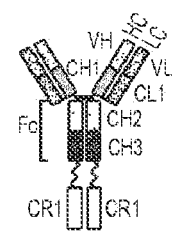 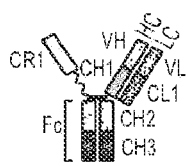
FIG. 26H  FIG. 26I  FIG. 26J
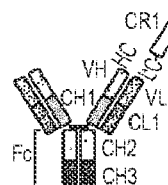 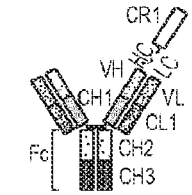
FIG. 26K  FIG. 26L A= PBS; B= C3d mAb-Crry; C= Non-targeted control (Crry); D= C3d mAb-fH$_{1-5}$; E= Non-targeted control (fH$_{1-5}$)

FUSION PROTEIN CONSTRUCTS COMPRISING ANTI-C3D ANTIBODY AND CR1 POLYPEPTIDE

CROSS-REFERENCE

This application is a continuation of International Application. No. PCT/US19/65741 filed Dec. 11, 2019, which claims priority to U.S. Provisional Application No. 62/778,014 filed Dec. 11, 2018, both of which are incorporated by reference herein in their entirety.

SEQUENCE LISTING

The instant application contains a Sequence Listing which has been submitted electronically in ASCII format and is hereby incorporated by reference in its entirety. Said ASCII copy, created on Dec. 11, 2019, is named 53542_707_601_SL.txt and is 950,242 bytes in size.

SUMMARY

Provided herein in one embodiment is a monomeric fusion protein construct that binds a complement-associated antigen; the monomeric fusion protein construct comprising: a first polypeptide comprising: a domain A and a domain B arranged from N-terminus to C-terminus in an A-B orientation, a second polypeptide comprising: a domain E and a domain F arranged from N-terminus to C-terminus in an E-F orientation, wherein at least one of domain A, domain B, domain E or domain F can be conjugated to a domain R, and wherein: domain A can comprise a heavy chain variable region amino acid sequence (VH) or an antigen-binding fragment thereof, domain B comprises a heavy chain CH1 constant region amino acid sequence, domain R comprises a complement modulator polypeptide, domain E can comprise a light chain variable region amino acid sequence (VL), or an antigen-binding fragment thereof, and domain F can comprise a light chain constant region amino acid sequence (CL1), wherein the domain B of the first polypeptide and domain F of the second polypeptide are linked via one or more disulfide bonds.

In some embodiments, the first polypeptide comprises the domain A, the domain B, and the domain. R, wherein the domains of the first polypeptide can be arranged, from N-terminus to C-terminus, in an R-A-B orientation, and wherein the domain R and the domain A are conjugated. In some embodiments, the first polypeptide comprises the domain A, the domain B, and the domain R, wherein the domains of the first polypeptide are arranged, from N-terminus to C-terminus, in an A-B-R orientation, and wherein the domain B and the domain R can be conjugated. In some embodiments, the second polypeptide comprises the domain E, the domain F, and the domain R, wherein the domains of the second polypeptide are arranged, from N-terminus to C-terminus, in an R-E-F orientation, and wherein the domain E and the domain R can be conjugated. In some embodiments, the second polypeptide comprises the domain E, the domain F, and the domain R, wherein the domains of the second polypeptide are arranged, from N-terminus to C-terminus, in an E-F-R orientation, and wherein the domain F and the domain R can be conjugated. In some embodiments, the monomeric fusion protein construct further comprises a second complement modulatory polypeptide, wherein the second complement modulatory polypeptide and domain R are the same or are different.

One embodiment provides a fusion protein construct that binds a complement-associated antigen, the fusion protein construct can comprise: a first polypeptide and a second polypeptide, wherein the first polypeptide comprises a domain A, a domain B, a domain R, a hinge region, a domain C, and a domain D, wherein the domains A,B, hinge region, C, and D of the first polypeptide are arranged, from N-terminus to C-terminus, in an A-B-hinge region-C-D orientation, wherein domain A can comprise a heavy chain variable region amino acid sequence (VH), or an antigen-binding fragment thereof, domain B can comprise a heavy chain CH1 constant region amino acid sequence, domain C can comprise a heavy chain CH2 constant region amino acid sequence, domain D can comprise a heavy chain CH3 constant region amino acid sequence, and domain R can comprise a complement modulator polypeptide, and wherein (1) domain A and domain R can be conjugated, or (2) domain D and domain R can be conjugated; the second polypeptide can comprise a domain E and a domain F, wherein the domains E and F of the second polypeptide are arranged, from N-terminus to C-terminus, in an E-F orientation, wherein (i) domain E can comprise a light chain variable region amino acid sequence (VL), or an antigen-binding fragment thereof, and (ii) domain F can comprise a light chain constant region amino acid sequence (CL1), and wherein the domain B of the first polypeptide and domain F of the second polypeptide are linked via one or more disulfide bonds.

In some embodiments, the fusion protein construct can be a tetravalent homodimeric fusion protein construct comprising two of the first polypeptide and two of the second polypeptide, wherein the domain D and the domain R can be conjugated in at least one of the first polypeptides, and wherein the two first polypeptides are linked together via one or more disulfide bonds at the hinge region. In some embodiments, the fusion protein construct can be a tetravalent homodimeric fusion protein construct comprising two of the first polypeptide and two of the second polypeptide, wherein the domain A and the domain R can be conjugated in at least one of the first polypeptides, and wherein the two first polypeptides are linked together via one or more disulfide bonds at the hinge region. In some embodiments, the fusion protein construct can further comprise domain R1, wherein domain R1 can comprise a second complement modulatory polypeptide, and wherein domain R1 and domain R can be the same or are different.

In some embodiments, domain A and domain R can be conjugated, and domain D and domain R1 can be conjugated. In some embodiments, domain D and domain R can be conjugated, and domain A and domain R1 can be conjugated. In some embodiments, the fusion protein construct can be a tetravalent heterodimeric fusion protein construct comprising c) a third polypeptide that comprises: (i) a domain A, a domain B, a hinge region, a domain C, and a domain D, (ii) a domain A, a domain B, a hinge region, and a domain C, or (iii) a domain A, a domain B, and a hinge region, wherein the domains A, B, hinge region, C, and D of the third polypeptide are arranged, from N-terminus to C-terminus, in an A-B-hinge region-C-D orientation; and d) a fourth polypeptide that comprises: a domain E and a domain F, wherein domains E and F of the fourth polypeptide are arranged, from N-terminus to C-terminus, in an E-F orientation, wherein the domain B of the third polypeptide and domain F of the fourth polypeptide are linked via one or more disulfide bonds, and wherein the first and third polypeptides are linked together via one or more disulfide bonds at the hinge region. In some embodiments, the domain D and the domain R can be conjugated in the first polypeptide. In some embodiments, the domain A and the domain R can be conjugated in the first polypeptide.

In some embodiments, the fusion protein construct can further comprise domain R1, wherein domain R1 comprises a second complement modulatory polypeptide, and wherein domain R1 and domain R can be the same or are different. In some embodiments, the domain R1 can be conjugated to the first polypeptide. In some embodiments, the domain R1 can be conjugated to the second polypeptide. In some embodiments, the domain R1 is conjugated to the third polypeptide. In some embodiments, the domain R1 is conjugated to the fourth polypeptide.

Another embodiment provides a fusion protein construct that binds a complement-associated antigen, the fusion protein construct comprising: a first polypeptide and a second polypeptide, wherein the first polypeptide comprises: a domain A, a domain B, a domain R, a hinge region, and a domain C, wherein the domains A,B, hinge region, and C of the first polypeptide can be arranged, from N-terminus to C-terminus, in an A-B-hinge region-C orientation, wherein domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence, and domain R comprises a complement modulator polypeptide, and wherein (1) domain A and domain R can be conjugated, or (2) domain C and domain R can be conjugated; the second polypeptide comprises a domain. E and a domain F, wherein the domains E and F can be arranged, from N-terminus to C-terminus, in an E-F orientation, wherein (i) domain E comprises a light chain variable region amino acid sequence (VL), or an antigen-binding fragment thereof, and (ii) domain F comprises a light chain constant region amino acid sequence (CL1), and wherein the domain B of the first polypeptide and domain F of the second polypeptide can be linked via one or more disulfide bonds.

In some embodiments, the fusion protein construct is a tetravalent homodimeric fusion protein construct comprising two of the first polypeptide and two of the second polypeptide, wherein the domain C and the domain R can be conjugated in at least one of the first polypeptides, and wherein the two first polypeptides can be linked together via one or more disulfide bonds at the hinge region. In some embodiments, the fusion protein construct is a tetravalent homodimeric fusion protein construct comprising two of the first polypeptide and two of the second polypeptide, wherein the domain A and the domain R can be conjugated in at least one of the first polypeptides, and wherein the two first polypeptides can be linked together via one or more disulfide bonds at the hinge region. In some embodiments, the fusion protein construct further comprises domain R1, wherein domain R1 can comprise a second complement modulatory polypeptide, and wherein domain R1 and domain R can be the same or can be different. In some embodiments, domain A and domain R can be conjugated, and domain C and domain R1 can be conjugated. In some embodiments, domain C and domain R can be conjugated, and domain A and domain R1 can be conjugated.

In some embodiments, the fusion protein construct is a tetravalent heterodimeric fusion protein construct comprising c) a third polypeptide that comprises: (i) a domain A, a domain B, a hinge region, a domain C, and a domain D, (ii) a domain A, a domain B, a hinge region, a domain C, or (iii) a domain A, a domain B, and a hinge region, wherein the domains A, B, hinge region, C, and D of the third polypeptide can be arranged, from N-terminus to C-terminus, in an A-B-hinge region-C-D orientation; and d) a fourth polypeptide that comprises: a domain E and a domain F, wherein domains E and F of the fourth polypeptide can be arranged, from N-terminus to C-terminus, in an E-F orientation, wherein the domain B of the third polypeptide and domain F of the fourth polypeptide can be linked via one or more disulfide bonds, and wherein the first and third polypeptides can be linked together via one or more disulfide bonds at the hinge region.

In some embodiments, the domain C and the domain R can be conjugated in the first polypeptide. In some embodiments, the domain A and the domain R can be conjugated in the first polypeptide. In some embodiments, the fusion protein construct further comprises domain R1, wherein domain R1 comprises a second complement modulatory polypeptide, and wherein domain R1 and domain R can be the same or can be different. In some embodiments, the domain R1 is conjugated to the first polypeptide. In some embodiments, the domain R1 is conjugated to the second polypeptide. In some embodiments, the domain R1 is conjugated to the third polypeptide. In some embodiments, the domain R1 is conjugated to the fourth polypeptide.

Another embodiment provides a fusion protein construct that binds a complement-associated antigen, the fusion protein comprising: a first polypeptide and a second polypeptide, wherein the first polypeptide comprises: a domain A, a domain B, a domain R, and a hinge region, wherein the domains A,B, and the hinge region of the first polypeptide can be arranged, from N-terminus to C-terminus, in an A-B-hinge region orientation, wherein domain A comprises a heavy chain variable region amino acid sequence (VH), or an antigen-binding fragment thereof, domain B comprises a heavy chain CH1 constant region amino acid sequence, domain R comprises a complement modulator polypeptide, and wherein (1) domain A and domain R can be conjugated, or (2) hinge region and domain R can be conjugated; the second polypeptide comprises a domain E and domain F, wherein the domains E and F can be arranged, from N-terminus to C-terminus, in an E-F orientation, wherein domain E comprises a light chain variable region amino acid sequence (VL), or an antigen-binding fragment thereof, and domain F comprises a light chain constant region amino acid sequence (CL1), and wherein the domain B of the first polypeptide and domain F of the second polypeptide can be linked via one or more disulfide bonds.

In some embodiments, the fusion protein construct is a tetravalent homodimeric fusion protein construct comprising two of the first polypeptide and two of the second polypeptide, wherein the domain A and the domain R can be conjugated in at least one of the first polypeptides, and wherein the two first polypeptides can be linked together via one or more disulfide bonds at the hinge region. In some embodiments, the fusion protein construct is a tetravalent homodimeric fusion protein construct comprising two of the first polypeptide and two of the second polypeptide, wherein the hinge region and the domain R can be conjugated in at least one of the first polypeptides, and wherein the two first polypeptides can be linked together via one or more disulfide bonds at the hinge region. In some embodiments, the fusion protein construct further comprises domain R1, wherein domain R1 comprises a second complement modulatory polypeptide, and wherein domain R1 and domain R can be the same or can be different. In some embodiments, domain A and domain R can be conjugated, and hinge domain and domain R1 can be conjugated. In some embodiments, the hinge domain and domain R can be conjugated, and domain A and domain R1 can be conjugated. In some embodiments, the fusion protein construct is a tetravalent heterodimeric fusion protein construct comprising c) a third polypeptide that comprises: (i) a domain A, a domain B, a hinge region, a domain C, and a domain D, (ii) a domain A, a domain B, a hinge region, and a domain C, or (iii) a domain A, a domain B, and a hinge region, wherein the domains A, B, hinge region, C, and D of the third polypeptide can be arranged, from N-terminus to C-terminus, in an A-B-hinge region-C-D orientation; and d) a fourth polypeptide that comprises: a domain E and a domain. F, wherein domains E and F of the fourth polypeptide can be arranged, from N-terminus to C-terminus, in an E-F orientation, wherein the domain B of the third polypeptide and domain F of the fourth polypeptide can be linked via one or more disulfide bonds, and wherein the first and third polypeptides can be linked together via one or more disulfide bonds at the hinge region.

In some embodiments, the hinge domain and the domain R can be conjugated in the first polypeptide. In some embodiments, the domain A and the domain R can be conjugated in the first polypeptide. In some embodiments, the fusion protein construct further comprises domain R1, wherein domain R1 comprises a second complement modulatory polypeptide, and wherein domain R1 and domain R can be the same or can be different. In some embodiments, the domain RI is conjugated to the first polypeptide. In some embodiments, the domain R1 is conjugated to the second polypeptide. In some embodiments, the domain R1 is conjugated to the third polypeptide. In some embodiments, the domain R1 is conjugated to the fourth polypeptide.

Another embodiment provides a trivalent heterodimeric fusion protein construct that binds a complement-associated antigen, the trivalent heterodimeric fusion protein construct comprising: a first polypeptide, a second polypeptide, a third polypeptide and a fourth polypeptide, wherein the first polypeptide comprises: a domain A, a domain B, a hinge region, a domain C, a domain D, and a domain R, wherein the domains A, B, hinge region, C, and D of the first polypeptide can be arranged, from N-terminus to C-terminus, in an A-B-hinge region-C-D orientation, and wherein (1) domain A and domain R can be conjugated, or (2) domain D and the domain R can be conjugated; the second polypeptide comprises: a domain E and a domain F, wherein domains E and F of the second polypeptide can be arranged, from N-terminus to C-terminus, in an E-F orientation; the third polypeptide comprises: (i) a domain A, a domain B, a hinge region, a domain C, and a domain D, (ii) a domain A, a domain B, a hinge region, and a domain C, or (iii) a domain A, a domain B, and a hinge region, wherein the domains A, B, hinge region, C, and D of the third polypeptide can be arranged, from N-terminus to C-terminus, in an A-B-hinge region-C-D orientation; the fourth polypeptide comprises: a domain E and a domain F, wherein domains E and F of the fourth polypeptide can be arranged, from N-terminus to C-terminus, in an E-F orientation; wherein domain B of the first polypeptide and domain F of the second polypeptide can be linked via one or more disulfide bonds and wherein domain B of the third polypeptide and domain F of the fourth polypeptide can be linked via one or more disulfide bonds, wherein the first and third polypeptides can be linked together via one or more disulfide bonds at the hinge region, and wherein domain A comprises a heavy chain variable region amino acid sequence (VH), or an antigen-binding fragment thereof, domain B comprises a heavy chain CH1 constant region amino acid sequence, domain R comprises a complement modulator polypeptide, domain C comprises a heavy chain CH2 constant region amino acid sequence, domain D comprises a heavy chain CH3 constant region amino acid sequence domain E comprises a light chain variable region amino acid sequence (VL), or an antigen-binding fragment thereof, and domain F comprises a light chain constant region amino acid sequence (CL1).

In some embodiments, the domain A and the domain R of the first polypeptide can be conjugated. In some embodiments, the domain D and the domain R of the first polypeptide can be conjugated.

Another embodiment provides a trivalent heterodimeric fusion protein construct that binds a complement-associated antigen, the trivalent heterodimeric fusion protein construct comprising: a first polypeptide, a second polypeptide, a third polypeptide and a fourth polypeptide, wherein the first polypeptide comprises: a domain A, a domain B, a hinge region, a domain C, and a domain R, wherein the domains A, B, hinge region, and C, of the first polypeptide can be arranged, from N-terminus to C-terminus, in an A-B-hinge region-C orientation, and wherein (1) the domain A and the domain R can be conjugated, or (2) the domain C and the domain R can be conjugated; the second polypeptide comprises: a domain E and a domain F, wherein domains E and F of the second polypeptide can be arranged, from N-terminus to C-terminus, in an E-F orientation; the third polypeptide comprises: (i) a domain A, a domain B, a hinge region, a domain C, and a domain D, (ii) a domain A, a domain B, a hinge region, and a domain C, or (iii) a domain A, a domain B, and a hinge region, wherein the domains A, B, hinge region, C and D of the third polypeptide can be arranged, from N-terminus to C-terminus, in an A-B-hinge region-C-D orientation; the fourth polypeptide comprises: a domain E and a domain F, wherein domains E and F of the fourth polypeptide can be arranged, from. N-terminus to C-terminus, in an E-F orientation; wherein domain B of the first polypeptide and domain F of the second polypeptide can be linked via one or more disulfide bonds and wherein domain B of the third polypeptide and domain F of the fourth polypeptide can be linked via one or more disulfide bonds, wherein the first and third polypeptides can be linked together via one or more disulfide bonds at the hinge region, and wherein domain A comprises a heavy chain variable region amino acid sequence (VH), or an antigen-binding fragment thereof, domain B comprises a heavy chain CH1 constant region amino acid sequence, domain R comprises a complement modulator polypeptide, domain C comprises a heavy chain CH2 constant region amino acid sequence, domain E comprises a light chain variable region amino acid sequence (VL), or an antigen-binding fragment thereof, and domain F comprises a light chain constant region amino acid sequence (CL1).

In some embodiments, the domain A and the domain R of the first polypeptide can be conjugated. In some embodiments, the domain C and the domain R of the first polypeptide can be conjugated.

Yet another embodiment provides a trivalent heterodimeric fusion protein construct that binds a complement-associated antigen, the trivalent heterodimeric fusion protein construct comprising a first polypeptide, a second polypeptide, a third polypeptide and a fourth polypeptide, wherein the first polypeptide comprises: a domain A, a domain B, a hinge region, and a domain R, wherein the domains A, B, and the hinge region of the first polypeptide can be arranged, from N-terminus to C-terminus, in an A-B-hinge region orientation, and wherein (1) the domain A and the domain R can be conjugated, or (2) the hinge region and the domain.

R can be conjugated; the second polypeptide comprises: a domain E and a domain F, wherein domains E and F of the second polypeptide can be arranged, from N-terminus to C-terminus, in an E-F orientation; the third polypeptide comprises: (i) a domain A, a domain B, a hinge region, a domain C, and a domain D, (ii) a domain A, a domain B, a hinge region, and a domain C, or (iii) a domain A, a domain B, and a hinge region, wherein the domains A, B, hinge region, C and D of the third polypeptide can be arranged, from N-terminus to C-terminus, in an A-B-hinge region-C-D orientation; the fourth polypeptide comprises: a domain E and a domain F, wherein domains E and F of the fourth polypeptide can be arranged, from N-terminus to C-terminus, in an E-F orientation; wherein domain B of the first polypeptide and domain F of the second polypeptide can be linked via one or more disulfide bonds and wherein domain B of the third polypeptide and domain F of the fourth polypeptide can be linked via one or more disulfide bonds, wherein the first and third polypeptides can be linked together via one or more disulfide bonds at the hinge region, and wherein domain A comprises a heavy chain variable region amino acid sequence (VH), or an antigen-binding fragment thereof, domain B comprises a heavy chain CH1 constant region amino acid sequence, domain R comprises a complement modulator polypeptide, domain E comprises a light chain variable region amino acid sequence (VL), or an antigen-binding fragment thereof, and domain F comprises a light chain constant region amino acid sequence (CL1).

In some embodiments, the domain A and the domain R of the first polypeptide can be conjugated. In some embodiments, the hinge region and the domain R of the first polypeptide can be conjugated.

Another embodiment provides a fusion protein construct that binds a complement-associated antigen, the fusion protein construct comprising: a first polypeptide and a second polypeptide, wherein the first polypeptide comprises: a domain A, a domain B, a hinge region, a domain C and a domain D, wherein the domains A,B, hinge region, C, and D can be arranged, from N-terminus to C-terminus, in an A-B-hinge region-C-D orientation, wherein domain. A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence, domain D comprises a heavy chain CH3 constant region amino acid sequence; the second polypeptide comprises: a domain E, domain F, and domain R, wherein the domains E and F can be arranged, from N-terminus to C-terminus, in an E-F orientation, wherein (1) the domain E and the domain R can be conjugated, or (2) the domain F and the domain R can be conjugated, and wherein domain E comprises a light chain variable region amino acid sequence (VL), or an antigen-binding fragment thereof, and domain F comprises a light chain constant region amino acid sequence (CL1), and wherein the domain B of the first polypeptide and domain F of the second polypeptide can be linked via one or more disulfide bonds.

In some embodiments, the fusion protein construct is a tetravalent homodimeric fusion protein construct comprising two of the first polypeptide and two of the second polypeptide, wherein the domain E and the domain R can be conjugated in at least one of the second polypeptides, and wherein the two first polypeptides can be linked together via one or more disulfide bonds at the hinge region. In some embodiments, the fusion protein construct is a tetravalent homodimeric fusion protein construct comprising two of the first polypeptide and two of the second polypeptide, wherein the domain F and the domain R can be conjugated in at least one of the second polypeptides, and wherein the two first polypeptides can be linked together via one or more disulfide bonds at the hinge region. In some embodiments, the fusion protein construct further comprises domain R1, wherein domain R1 comprises a second complement modulatory polypeptide, and wherein domain R1 and domain R can be the same or can be different. In some embodiments, domain E and domain R can be conjugated, and domain F and domain R1 can be conjugated. In some embodiments, domain F and domain R can be conjugated, and domain E and domain R1 can be conjugated. In some embodiments, the fusion protein construct is a tetravalent heterodimeric fusion protein construct comprising c) a third polypeptide that comprises: (1) a domain A, a domain B, a hinge region, a domain C, and a domain D (ii) a domain A, a domain B, a hinge region, and a domain C, or (iii) a domain A, a domain B, and a hinge region, wherein the domains A, B, hinge region, C, and D of the third polypeptide can be arranged, from N-terminus to C-terminus, in an A-B-hinge region-C-D orientation; and d) a fourth polypeptide that comprises: a domain E and a domain F, wherein domains E and F of the fourth polypeptide can be arranged, from N-terminus to C-terminus, in an E-F orientation, wherein the domain B of the third polypeptide and domain F of the fourth polypeptide can be linked via one or more disulfide bonds, and wherein the first and third polypeptides can be linked together via one or more disulfide bonds at the hinge region.

In some embodiments, the domain E and the domain R can be conjugated in the first polypeptide. In some embodiments, the domain F and the domain R can be conjugated in the first polypeptide. In some embodiments, the fusion protein construct further comprises domain R1, wherein domain R1 comprises a second complement modulatory polypeptide, and wherein domain R1 and domain R can be the same or can be different. In some embodiments, the domain R1 is conjugated to the first polypeptide. In some embodiments, the domain R1 is conjugated to the second polypeptide. In some embodiments, the domain R1 is conjugated to the third polypeptide. In some embodiments, the domain R1 is conjugated to the fourth polypeptide.

Another embodiment provides a fusion protein construct that binds a complement-associated antigen, the fusion protein construct comprising: a first polypeptide and a second polypeptide, wherein the first polypeptide comprises: a domain A, a domain B, a hinge region, and a domain C, wherein the domains A,B, hinge region, and C can be arranged, from N-terminus to C-terminus, in an A-B-hinge region-C orientation, wherein domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence; the second polypeptide comprises: a domain E, domain F, and domain R, wherein the domains E and F can be arranged, from N-terminus to C-terminus, in an E-F orientation, wherein (1) the domain E and the domain R can be conjugated, or (2) the domain F and the domain R can be conjugated, and wherein domain E comprises a light chain variable region amino acid sequence (VL), or an antigen-binding fragment thereof, and domain F comprises a light chain constant region amino acid sequence (CL1), and wherein the domain B of the first polypeptide and domain F of the second polypeptide can be linked via one or more disulfide bonds.

In some embodiments, the fusion protein construct is a tetravalent homodimeric fusion protein construct comprising two of the first polypeptide and two of the second polypeptide, wherein the domain E and the domain R can be conjugated in at least one of the second polypeptides, and wherein the two first polypeptides can be linked together via one or more disulfide bonds at the hinge region. In some embodiments, the fusion protein construct is a tetravalent homodimeric fusion protein construct comprising two of the first polypeptide and two of the second polypeptide, wherein the domain F and the domain R can be conjugated in at least one of the second polypeptides, and wherein the two first polypeptides can be linked together via one or more disulfide bonds at the hinge region. In some embodiments, the fusion protein construct further comprises domain R1, wherein domain R1 comprises a second complement modulatory polypeptide, and wherein domain R1 and domain R can be the same or can be different. In some embodiments, domain. E and domain R can be conjugated, and domain. F and domain R1 can be conjugated. In some embodiments, the fusion protein construct domain F and domain R can be conjugated, and domain E and domain R1 can be conjugated. In some embodiments, the fusion protein construct is a tetravalent heterodimeric fusion protein construct comprising c) a third polypeptide that comprises: (i) a domain A, a domain B, a hinge region, a domain C, and a domain D (ii) a domain A, a domain B, a hinge region, and a domain C, or (iii) a domain A, a domain B, and a hinge region, wherein the domains A, B, hinge region, C, and D of the third polypeptide can be arranged, from N-terminus to C-terminus, in an A-B-hinge region-C-D orientation; and d) a fourth polypeptide that comprises: a domain E and a domain. F, wherein domains E and F of the fourth polypeptide can be arranged, from N-terminus to C-terminus, in an E-F orientation, wherein the domain B of the third polypeptide and domain F of the fourth polypeptide can be linked via one or more disulfide bonds, and wherein the first and third polypeptides can be linked together via one or more disulfide bonds at the hinge region.

In some embodiments, the domain E and the domain R can be conjugated in the first polypeptide. In some embodiments, the domain F and the domain R can be conjugated in the first polypeptide. In some embodiments, the fusion protein construct further comprises domain R1, wherein domain R1 comprises a second complement modulatory polypeptide, and wherein domain R1 and domain R can be the same or can be different. In some embodiments, the domain R1 is conjugated to the first polypeptide. In some embodiments, the domain R1 is conjugated to the second polypeptide. In some embodiments, the domain R1 is conjugated to the third polypeptide. In some embodiments, the domain R1 is conjugated to the fourth polypeptide.

Yet another embodiment provides a fusion protein construct that binds a complement-associated antigen, the fusion protein construct comprising; a first polypeptide and a second polypeptide, wherein the first polypeptide comprises: a domain A, a domain B, and a hinge region, wherein the domains A,B, and hinge region can be arranged, from N-terminus to C-terminus, in an A-B-hinge region orientation, wherein domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence; the second polypeptide comprises: a domain E, domain F, and domain R, wherein the domains E and F can be arranged, from N-terminus to C-terminus, in an E-F orientation, wherein (1) the domain E and the domain R can be conjugated, or (2) the domain F and the domain R can be conjugated, and wherein domain E comprises a light chain variable region amino acid sequence (VL), or an antigen-binding fragment thereof, and domain F comprises a light chain constant region amino acid sequence (CL1), and wherein the domain B of the first polypeptide and domain F of the second polypeptide can be linked via one or more disulfide bonds.

In some embodiments, the fusion protein construct is a tetravalent homodimeric fusion protein construct comprising two of the first polypeptide and two of the second polypeptide, wherein the domain E and the domain R can be conjugated in at least one of the second polypeptides, and wherein the two first polypeptides can be linked together via one or more disulfide bonds at the hinge region. In some embodiments, the fusion protein construct is a tetravalent homodimeric fusion protein construct comprising two of the first polypeptide and two of the second polypeptide, wherein the domain F and the domain R can be conjugated in at least one of the second polypeptides, and wherein the two first polypeptides can be linked together via one or more disulfide bonds at the hinge region. In some embodiments, the fusion protein construct further comprises domain R1, wherein domain R1 comprises a second complement modulatory polypeptide, and wherein domain R1 and domain R can be the same or can be different. In some embodiments, domain E and domain R can be conjugated, and domain F and domain R1 can be conjugated. In some embodiments, domain F and domain R can be conjugated, and domain E and domain R1 can be conjugated.

In some embodiments, the fusion protein construct is a tetravalent heterodimeric fusion protein construct comprising c) a third polypeptide that comprises: (i) a domain A, a domain B, a hinge region, a domain C, and a domain D, (ii) a domain A, a domain B, a hinge region, and a domain C, or (iii) a domain A, a domain. B, and a hinge region, wherein the domains A, B, hinge region, C, and D of the third polypeptide can be arranged, from N-terminus to C-terminus, in an A-B-hinge region-C-D orientation; and d) a fourth polypeptide that comprises: a domain E and a domain F, wherein domains E and F of the fourth polypeptide can be arranged, from N-terminus to C-terminus, in an E-F orientation, wherein the domain B of the third polypeptide and domain F of the fourth polypeptide can be linked via one or more disulfide bonds, and wherein the first and third polypeptides can be linked together via one or more disulfide bonds at the hinge region.

In some embodiments, the domain E and the domain R can be conjugated in the first polypeptide. In some embodiments, the domain F and the domain R can be conjugated in the first polypeptide.

In some embodiments, the fusion protein construct further comprises domain R1, wherein domain R1 comprises a second complement modulatory polypeptide, and wherein domain R1 and domain R can be the same or can be different. In some embodiments, the domain R1 is conjugated to the first polypeptide. In some embodiments, the domain R1 is conjugated to the second polypeptide. In some embodiments, the domain R1 is conjugated to the third polypeptide. In some embodiments, the domain R1 is conjugated to the fourth polypeptide.

Another embodiment provides a trivalent heterodimeric fusion protein construct that binds a complement-associated antigen, the trivalent heterodimeric fusion protein construct comprising: a first polypeptide, a second polypeptide, a third polypeptide and a fourth polypeptide, wherein the first polypeptide comprises: a domain A, a domain B, a hinge region, a domain C, and a domain D, wherein the domains A, B, the hinge region, C, and D of the first polypeptide can be arranged, from N-terminus to C-terminus, in an A-B-hinge region-C-D orientation; the second polypeptide comprises: a domain E, a domain F, and a domain R, wherein the domains E and F can be arranged, from N-terminus to C-terminus, in an E-F orientation, wherein (1) the domain E and the domain R can be conjugated, or (2) the domain F and the domain R can be conjugated; the third polypeptide comprises: (i) a domain A, a domain B, a domain C, a domain D, and a hinge region, (ii) a domain A, a domain B, a domain C, and a hinge region, or (iii) a domain A, a domain B, and a hinge region, wherein the domains A, B, hinge region, C, and D of the third polypeptide can be arranged, from N-terminus to C-terminus, in an A-B-hinge region-C-D orientation; the fourth polypeptide comprises: a domain E and a domain F, wherein domains E and F of the fourth polypeptide can be arranged, from N-terminus to C-terminus, in an E-F orientation; wherein domain B of the first polypeptide and domain F of the second polypeptide can be linked via one or more disulfide bonds and wherein domain B of the third polypeptide and domain F of the fourth polypeptide can be linked via one or more disulfide bonds, wherein the first and third polypeptides can be linked together via one or more disulfide bonds at the hinge region, and wherein domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence, domain D comprises a heavy chain CH3 constant region amino acid sequence, domain R comprises a complement modulator polypeptide, domain E comprises a light chain variable region amino acid sequence (VL), or an antigen-binding fragment thereof, and domain F comprises a light chain constant region amino acid sequence (CL1).

In some embodiments, the domain E and the domain R of the second polypeptide can be conjugated. In some embodiments, the domain F and the domain R of the second polypeptide can be conjugated.

Another embodiment provides a trivalent heterodimeric fusion protein construct that binds a complement-associated antigen, the trivalent heterodimeric fusion protein construct comprising: a first polypeptide, a second polypeptide, a third polypeptide and a fourth polypeptide, wherein the first polypeptide comprises: a domain A, a domain B, a hinge region, and a domain C, wherein the domains A, B, the hinge region, and C of the first polypeptide can be arranged, from N-terminus to C-terminus, in an A-B-hinge region-C orientation; the second polypeptide comprises: a domain E, a domain F, and a domain R, wherein the domains E and F can be arranged, from N-terminus to C-terminus, in an E-F orientation, wherein (1) the domain E and the domain R can be conjugated, or (2) the domain F and the domain R can be conjugated; the third polypeptide comprises: (i) a domain A, a domain B, a domain C, a domain D, and a hinge region, (ii) a domain A, a domain B, a domain C, and a hinge region, or (iii) a domain A, a domain B, and a hinge region, wherein the domains A, B, hinge region, C and D of the third polypeptide can be arranged, from N-terminus to C-terminus, in an A-B-hinge region-C-D orientation; the fourth polypeptide comprises: a domain E and a domain F, wherein domains E and F of the fourth polypeptide can be arranged, from. N-terminus to C-terminus, in an E-F orientation; wherein domain B of the first polypeptide and domain F of the second polypeptide can be linked via one or more disulfide bonds and wherein domain B of the third polypeptide and domain F of the fourth polypeptide can be linked via one or more disulfide bonds, wherein the first and third polypeptides can be linked together via one or more disulfide bonds at the hinge region, and wherein domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence, domain R comprises a complement modulator polypeptide, domain E comprises a light chain variable region amino acid sequence (VL), or an antigen-binding fragment thereof, and domain F comprises a light chain constant region amino acid sequence (CL1).

In some embodiments, the domain E and the domain R of the second polypeptide can be conjugated. In some embodiments, the domain F and the domain R of the second polypeptide can be conjugated.

Another embodiment provides a trivalent heterodimeric fusion protein construct that binds a complement-associated antigen, the trivalent heterodimeric fusion protein construct comprising: a first polypeptide, a second polypeptide, a third polypeptide and a fourth polypeptide, wherein the first polypeptide comprises: a domain A, a domain B, and a hinge region, wherein the domains A, B, and the hinge region of the first polypeptide can be arranged, from N-terminus to C-terminus, in an A-B-hinge region orientation; the second polypeptide comprises: a domain E, a domain F, and a domain R, wherein the domains E and F can be arranged, from N-terminus to C-terminus, in an E-F orientation, wherein (1) the domain E and the domain R can be conjugated, or (2) the domain F and the domain R can be conjugated; the third polypeptide comprises: (i) a domain A, a domain B, a domain C, a domain D, and a hinge region, (ii) a domain A, a domain B, a domain C, and a hinge region, or (iii) a domain A, a domain B, and a hinge region, wherein the domains A, B, the hinge region, C and D of the third polypeptide can be arranged, from N-terminus to C-terminus, in an A-B-hinge region-C-D orientation; the fourth polypeptide comprises: a domain E and a domain F, wherein domains E and F of the fourth polypeptide can be arranged, from N-terminus to C-terminus, in an E-F orientation; wherein domain B of the first polypeptide and domain F of the second polypeptide can be linked via one or more disulfide bonds and wherein domain B of the third polypeptide and domain F of the fourth polypeptide can be linked via one or more disulfide bonds, wherein the first and third polypeptides can be linked together via one or more disulfide bonds at the hinge region, and wherein domain A comprises a heavy chain variable region amino acid sequence (VH), or an antigen-binding fragment thereof, domain B comprises a heavy chain CH1 constant region amino acid sequence, domain R comprises a complement modulator polypeptide, domain E comprises a light chain variable region amino acid sequence (VL), or an antigen-binding fragment thereof, and domain F comprises a light chain constant region amino acid sequence (CL1).

In some embodiments, the domain E and the domain R of the second polypeptide can be conjugated. In some embodiments, the domain F and the domain R of the second polypeptide can be conjugated.

Another embodiment provides a fusion protein construct that binds a complement-associated antigen, the fusion protein construct comprising: a first polypeptide, a second polypeptide, and a third polypeptide, wherein the first polypeptide comprises a domain R, a hinge region, a domain C and a domain D, wherein the domains R, hinge region, C, and D can be arranged, from N-terminus to C-terminus, in an R-hinge-C-D orientation, and wherein domain R comprises a complement modulator polypeptide, domain C comprises a heavy chain CH2 constant region amino acid sequence, domain D comprises a heavy chain CH3 constant region amino acid sequence; wherein domain R and the hinge domain can be conjugated, the second polypeptide comprises a domain A, a domain B, a hinge region, a domain C, and a domain D, wherein the domains A, B, hinge region, C, and D can be arranged, from N-terminus to C-terminus arranged, in an A-B-hinge-C-D orientation, and wherein domain A comprises a heavy chain variable region amino acid sequence (VH), or an antigen-binding fragment thereof, and domain B comprises a heavy chain CH1 constant region amino acid sequence; the third polypeptide comprises a domain E and a domain F, wherein the domains can be arranged, from N-terminus to C-terminus, in an E-F orientation, and wherein domain E comprises a light chain variable region amino acid sequence (VL), or an antigen-binding fragment thereof, domain F comprises a light chain constant region amino acid sequence (CL1); wherein domain B of the second polypeptide and domain F of the third polypeptide can be linked via one or more disulfide bonds; and wherein the first and second polypeptides can be linked together via one or more disulfide bonds at the hinge region.

Another embodiment provides a monomeric fusion protein construct that binds a complement-associated antigen, the monomeric fusion protein construct comprising: a first polypeptide comprising: a domain A, a domain B, and a hinge region, arranged, from N terminus to C terminus in an A-B-hinge orientation; a second polypeptide comprising: a domain E, and a domain F, arranged, from N-terminus to C-terminus in an E-F orientation, wherein at least one of domain A, hinge domain, domain E or domain F is conjugated to a domain R, and wherein: domain A comprises a heavy chain variable region amino acid sequence (VH), or an antigen-binding fragment thereof, domain B comprises a heavy chain CH1 constant region amino acid sequence, domain R comprises a complement modulator polypeptide, domain E comprises a light chain variable region amino acid sequence (VL), or an antigen-binding fragment thereof, and domain F comprises a light chain constant region amino acid sequence (CL1) wherein the domain B of the first polypeptide and domain F of the second polypeptide can be linked via one or more disulfide bonds.

In some embodiments, the first polypeptide comprises the domain A, the domain B, the hinge domain, and the domain R, wherein the domains of the first polypeptide can be arranged, from N-terminus to C-terminus, in an R-A-B-hinge orientation, and wherein the domain R and the domain A can be conjugated. In some embodiments, the first polypeptide comprises the domain A, the domain B, the hinge domain, and the domain R, wherein the domains of the first polypeptide can be arranged, from N-terminus to C-terminus, in an A-B-hinge-R orientation, and wherein the hinge domain and the domain R can be conjugated. In some embodiments, the second polypeptide comprises the domain E, the domain F, and the domain R, wherein the domains of the second polypeptide can be arranged, from N-terminus to C-terminus, in an R-E-F orientation, and wherein the domain E and the domain R can be conjugated. In some embodiments, the second polypeptide comprises the domain E, the domain F, and the domain R, wherein the domains of the second polypeptide can be arranged, from N-terminus to C-terminus, in an E-F-R orientation, and wherein the domain F and the domain R can be conjugated. In some embodiments, the fusion protein construct further comprises a second complement modulatory polypeptide, wherein the second complement modulatory polypeptide and domain R can be the same or can be different.

Another embodiment provides a monomeric fusion protein construct that binds a complement-associated antigen, the monomeric fusion protein construct comprising: a first polypeptide comprising: a domain A, a domain B, a hinge region, and a domain C arranged, from N terminus to C terminus in an A-B-hinge-C region orientation; a second polypeptide comprising: a domain E, and a domain F, arranged, from N-terminus to C-terminus in an E-F orientation, wherein at least one of domain A, domain C, domain E or domain F is conjugated to a domain R, and wherein: domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence, domain R comprises a complement modulator polypeptide, domain E comprises a light chain variable region amino acid sequence (VL), or an antigen-binding fragment thereof, and domain F comprises a light chain constant region amino acid sequence (CL1) wherein the domain B of the first polypeptide and domain F of the second polypeptide can be linked via one or more disulfide bonds.

In some embodiments, the first polypeptide comprises the domain A, the domain B, the hinge domain, the domain C, and the domain R, wherein the domains of the first polypeptide can be arranged, from N-terminus to C-terminus, in an R-A-B-hinge-C orientation, and wherein the domain R and the domain A can be conjugated. In some embodiments, the first polypeptide comprises the domain A, the domain B, the hinge domain, the domain C, and the domain R, wherein the domains of the first polypeptide can be arranged, from N-terminus to C-terminus, in an A-B-hinge-C-R orientation, and wherein the domain C and the domain R can be conjugated. In some embodiments, the second polypeptide comprises the domain E, the domain F, and the domain R, wherein the domains of the second polypeptide can be arranged, from N-terminus to C-terminus, in an R-E-F orientation, and wherein the domain E and the domain R can be conjugated. In some embodiments, the second polypeptide comprises the domain E, the domain F, and the domain R, wherein the domains of the second polypeptide can be arranged, from N-terminus to C-terminus, in an E-F-R orientation, and wherein the domain F and the domain R can be conjugated. In some embodiments, the fusion protein construct further comprises a second complement modulatory polypeptide, wherein the second complement modulatory polypeptide and domain R can be the same or can be different.

Another embodiment provides a monomeric fusion protein construct that binds a complement-associated antigen, the monomeric fusion protein construct comprising: a) a first polypeptide comprising: a domain A, a domain B, a hinge region, a domain C and a domain D arranged, from N terminus to C terminus in an A-B-hinge-C-D region orientation; b) a second polypeptide comprising: a domain E, and a domain F, arranged, from N-terminus to C-terminus in an E-F orientation, wherein at least one of domain A, domain D, domain E or domain F is conjugated to a domain R, and wherein: (i) domain A comprises a heavy chain variable region amino acid sequence (VH), or an antigen-binding fragment thereof, (ii) domain B comprises a heavy chain CH1 constant region amino acid sequence, (iii)domain C comprises a heavy chain CH2 constant region amino acid sequence, (iv) domain D comprises a heavy chain CH3 constant region amino acid sequence, (v) domain R comprises a complement modulator polypeptide, (vi) domain E comprises a light chain variable region amino acid sequence (VL), or an antigen-binding fragment thereof, and (vii) domain F comprises a light chain constant region amino acid sequence (CL1) wherein the domain B of the first polypeptide and domain F of the second polypeptide can be linked via one or more disulfide bonds.

In some embodiments, the first polypeptide comprises the domain A, the domain B, the hinge domain, the domain C, the domain D and the domain R, wherein the domains of the first polypeptide can be arranged, from N-terminus to C-terminus, in an R-A-B-hinge-C-D orientation, and wherein the domain R and the domain A can be conjugated. In some embodiments, the first polypeptide comprises the domain A, the domain B, the hinge domain, the domain C, the domain D, and the domain. R, wherein the domains of the first polypeptide can be arranged, from N-terminus to C-terminus, in an A-B-hinge-C-D-R orientation, and wherein the domain C and the domain R can be conjugated. In some embodiments, the second polypeptide comprises the domain E, the domain F, and the domain R, wherein the domains of the second polypeptide can be arranged, from N-terminus to C-terminus, in an R-E-F orientation, and wherein the domain E and the domain R can be conjugated. In some embodiments, the second polypeptide comprises the domain E, the domain F, and the domain R, wherein the domains of the second polypeptide can be arranged, from N-terminus to C-terminus, in an E-F-R orientation, and wherein the domain F and the domain R can be conjugated. In some embodiments, the fusion protein construct further comprises a second complement modulatory polypeptide, wherein the second complement modulatory polypeptide and domain R can be the same or can be different.

In some embodiments, the conjugation comprises linking of two domains with a peptide linker, without a linker, an enzymatic conjugation, a chemical conjugation, or any combination thereof. In some embodiments, the complement-associated antigen is C3d, iC3b, C3dg or fragments thereof, or variants thereof. In some embodiments, the fusion protein construct binds C3 and C3b with lower binding affinity than that toward C3d. In some embodiments, the fusion protein construct binds C3 and C3b with a KD affinity of about $10^{-3}$ M or higher. In some embodiments, the fusion protein construct binds iC3b, C3dg, or both, with a KD affinity of $10^{-8}$ M or less. In some embodiments, the fusion protein construct modulates alternative complement activity in a subject upon administration of the fusion protein construct or a pharmaceutical composition comprising the fusion protein construct, to the subject. In some embodiments, the fusion protein construct modulates classical complement activity in a subject upon administration of the fusion protein construct or a pharmaceutical composition comprising the fusion protein construct, to the subject. In some embodiments, the fusion protein construct modulates lectin complement activity in a subject upon administration of the fusion protein construct or a pharmaceutical composition comprising the fusion protein construct, to the subject. In some embodiments, the fusion protein construct binds a domain of a mammalian annexin protein.

In some embodiments, the fusion protein construct binds the domain of a mammalian annexin protein with a KD affinity of $10^{-8}$M or less. In some embodiments, the domain is an annexin core domain. In some embodiments, the annexin core domain comprises an alpha-helical domain. In some embodiments, the annexin core domain comprises a calcium binding site and a membrane binding site. In some embodiments, the annexin core domain comprises at least one annexin repeat. In some embodiments, the fusion protein construct binds an annexin repeat sequence within the domain. In some embodiments, the fusion protein construct binds a phospholipid. In some embodiments, the fusion protein construct binds the phospholipid with a KD affinity of $10^{-8}$M or less. In some embodiments, the phospholipid is selected from the group consisting of phosphatidylethanolamine (PE), cardiolipin (CL), phosphatidylcholine (PC), phosphatidylinositol, phosphatidylglycerol, phosphatidylserine, and phosphatidic acid, and malondialdehyde (MDA). In some embodiments, the complement modulator peptide comprises domain A of a complement receptor 1 (CR1) protein or a fragment thereof that retains at least three short consensus repeats (SCRs) of domain A. In some embodiments, the fusion protein construct further comprises domain B of the CR1 protein or a fragment thereof that retains at least three SCRs of domain B.

In some embodiments, the fusion protein construct further comprises domain C of the CR1 protein or a fragment thereof that retains at least three SCRs of domain C. In some embodiments, the fusion protein construct further comprises domain D of the CR1 or a fragment thereof that retains at least three SCRs of domain D. In some embodiments, the complement modulator polypeptide comprises the first three SCRs of domain A, the first three SCRs of domain B, and the first three SCRs of domain C of the CR1 protein. In some embodiments, the complement modulator polypeptide is CR1 (1-10). In some embodiments, the complement modulator polypeptide is CR1 (1-17). In some embodiments, the complement modulator peptide comprises the amino acid sequence of SEQ ID No. 41 or SEQ ID No. 91, or a variant thereof with an amino acid sequence at least 85% identical. In some embodiments, the complement modulator polypeptide comprises the amino acid sequence of SEQ ID No. 42 or SEQ ID No. 92, or a variant thereof with an amino acid sequence at least 85% identical. In some embodiments, the complement modulator peptide is decay-accelerating factor (DAF) or a biologically active fragment thereof. In some embodiments, the DAF is a human DAF. In some embodiments, the biologically active fragment of human DAF comprises at least one of a short consensus repeat (SCR) domain and an O-glycosylated serine/threonine-rich domain of a full-length human DAF.

In some embodiments, the biologically active fragment of DAF comprises SCR 1 to 4, or SCR 2 to 4 of a full-length human DAF. In some embodiments, the biologically active fragment of DAF comprises the amino acid sequence of SEQ ID No. 184, or a variant thereof with an amino acid sequence at least 85% identical. In some embodiments, the complement modulator peptide is factor H or a biologically active fragment thereof. In some embodiments, the factor H is a human factor H. In some embodiments, the biologically active fragment of human factor H comprises one or more groups of short consensus repeats (SCRs) comprising SCRs 1 to 20, SCRs 1 to 2, SCRs 2 to 3, SCRs 3 to 4, SCRs 4 to 5, SCRs 5 to 6, SCRs 6 to 7, SCRs 7 to 8, SCRs 8 to 9, SCRs 9 to 10, SCRs 10 to 11, SCRs 11 to 12, SCRs 12 to 13, SCRs 13 to 14, SCRs 14 to 15, SCRs 15 to 16, SCRs 16 to 17, SCRs 17 to 18, SCRs 19 to 20 of a full-length human factor H, or any combination of SCRs 1 to 20. In some embodiments, the biologically active fragment of human factor H comprises SCRs 1 to 4 or SCRs 1 to 5 of a full-length human factor H. In some embodiments, the biologically active fragment of human factor H comprises a stretch of amino acids selected from the group consisting of: amino acids 21-266, amino acids 21-320, amino acids 21-509 or amino acids 19-1106 of SEQ ID No. 9, or a variant thereof with an amino acid sequence at least 85% identical to the stretch of amino acids.

In some embodiments, the factor H or biologically active fragment thereof comprises the amino acid sequence of SEQ ID NO: 72 or SEQ ID NO: 108, or a variant thereof with an amino acid sequence at least 85% identical. In some embodiments, the complement modulator peptide is MCP or a biologically active fragment thereof. In some embodiments, the MCP is human MCP. In some embodiments, the biologically active fragment of human MCP comprises at least one of a short consensus repeat (SCR) domain of a full-length human MCP. In some embodiments, the biologically active fragment of human MCP comprises SCRs 3 to 4 of the full-length human MCP. In some embodiments, the MCP comprises the amino acid sequence of SEQ ID NO: 187, or a variant thereof with an amino acid sequence at least 85% identical. In some embodiments, the complement modulator peptide is Map44 or a biologically active fragment thereof. In some embodiments, the Map44 is human Map44. In some embodiments, the Map44 comprises the amino acid sequence of SEQ ID NO: 186, or a variant thereof with an amino acid sequence at least 85% identical. In some embodiments, the complement modulator peptide is CD59 or a biologically active fragment thereof.

In some embodiments, the CD59 is human CD59.

In some embodiments, the CD59 comprises the amino acid sequence of SEQ ID NO: 185, or a variant thereof with an amino acid sequence at least 85% identical. In some embodiments, the fusion protein construct comprises a human antibody or an antigen-binding fragment thereof. In some embodiments, the fusion protein construct comprises a humanized antibody or an antigen-binding fragment thereof. In some embodiments, the first and third polypeptides each comprise at least one orthogonal modification that favors formation of a heterodimer as compared to a homodimer. In some embodiments, the first polypeptide comprises a knob modification, and the third polypeptide comprises a hole modification; or wherein the third polypeptide comprises a knob modification and the first polypeptide comprises a hole modification. In some embodiments, the first and third polypeptides comprise modifications resulting in charge or surface complementarity.

In some embodiments, (a) the first polypeptide comprises (i) three heavy chain complementarity determining regions (CDRs) having the amino acid sequences of SEQ ID NOs: 11, 12 and 13; 17, 18 and 19; 23, 24 and 25; 29, 30 and 31; 35, 36 and 37; 147, 148, and 149; 188, 189, and 190; 196, 197, and 198; 204 or 343, 205, and 206; 212, 213, and 214; 220, 221, and 222; 228, 229, and 230; 29, 259 and 31; or 29, 260 and 31; or (ii) three heavy chain CDRs having amino acid sequences that differ by a single conservative amino acid substitution within one of SEQ ED NOs; 11, 12 and 13; 17, 18 and 19; 23.24 and 25; 29, 30 and 31; 35, 36 and 37; 147, 148, and 149; 188, 189, and 190; 196, 197, and 198; 204 or 343, 205, and 206; 212, 213, and 214; 220, 221, and 222; 228, 229, and 230; 29, 259 and 31; or 29, 260 and 31; and (b) the second polypeptide comprises (i) three light chain complementarity determining regions (CDRs) having the amino acid sequences of SEQ ID NOs: 14, 15 and 16; 20, 21 and 22; 26, 27 and 28; 32, 33 and 34; 38, 39, and 40; 150, 151, and 152; 191, 192, and 193; 199, 200, and 201; 207, 208, and 209; 215, 216, and 217;223, 224 and 225; or 231, 232, and 233, or (ii) three light chain CDRs having amino acid sequences that differ by a single conservative amino acid substitution within one of SEQ ID NOs 14, 15 and 16; 20, 21 and 22; 26, 27 and 28; 32, 33 and 34; 38, 39, and 40; 150, 151, and 152; 191, 192, and 193; 199, 200, and 201; 207, 208, and 209; 215, 216, and 217;223, 224 and 225; or 231, 232, and 233.

In some embodiments, the second polypeptide (the light chain comprising domains E and F) comprises at least three CDRs, wherein the light chain CDRs are defined as CDR-L1, CDR-L2, CDR-L3, respectively: for SEQ ID Nos. 279, 68, 287, and 59, the CDRs comprise residues 27-37 (CDR-L1), 55-57 (CDR-L2), and 94-102 (CDR-L3); for SEQ ID No. 289 the CDRs comprise residues 27-38 (CDR-L1), 56-58 (CDR-L2), 95-102 (CDR-L3). In some embodiments, the first polypeptide (the heavy chain comprising at least domains A and B) comprises at least three CDRs, wherein the heavy chain CDRs are defined as CDR-H1, CDR-H2, CDR-H3, respectively: for SEQ ID Nos. 280, 281, 282, 284, 285, 286, 73, and 288 the CDRs comprise residues 26-33 (CDR-H1), 51-58 (CDR-112), and 97-100 (CDR-H3); for SEQ ID No. 244, the CDRs comprise residues 26-33 (CDR-H1), 51-58 (CDR-H2), and 97-102 (CDR-H3); for SEQ ID No. 290, the CDRs comprise residues 26-33 (CDR-H1), 51-58 (CDR-H2), and 97-110 (CDR-H3). In some embodiments, the first polypeptide (the heavy chain comprising at least domains A and B) comprises at least three CDRs, wherein the heavy chain CDRs are defined as CDR-H1, CDR-H2, CDR-H3, respectively, for SEQ ID No. 342, comprise SEQ ID No. 23, SEQ ID No. 24, and SEQ ID No. 25. In some embodiments, the second polypeptide (the light chain comprising at least domains E and F) comprises at least three CDRs, wherein the light chain CDRs are defined as CDR-L1, CDR-L2, CDR-L3, respectively, for the light chain, comprise SEQ ID No. 26, SEQ ID No. 27, and SEQ ID No. 28.

In some embodiments, the fusion protein construct further comprises at least one amino acid linker, wherein the at least one linker comprises the amino acid sequence of any of SEQ ID NO: 138, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 241, or SEQ NO: 242.

In some embodiments, the fusion protein construct can comprise the amino acid sequence of at least one of SEQ ID NO: 43, SEQ ID NO: 44, SEQ ID NO: 46, SEQ ID NO: 47, SEQ ID NO: 48, SEQ ID NO: 49, SEQ ID NO: 50, SEQ ID NO: 52, SEQ ID NO: 53, SEQ ID NO: 55, SEQ ID NO: 56, SEQ ID NO: 57, SEQ ID NO: 60, SEQ ID NO: 61, SEQ ID NO: 63, SEQ ID NO: 65, SEQ ID NO: 66, SEQ ID NO: 69, SEQ ID NO: 70, SEQ ID NO: 71, SEQ ID NO: 75, SEQ ID NO: 76, SEQ ID NO: 77, SEQ ID NO: 78, SEQ ID NO: 79, SEQ ID NO: 80, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 90, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 109, SEQ ID NO: 110, SEQ ID NO: 111, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 140, SEQ ID NO: 141, SEQ ID NO: 142, SEQ ID NO: 143, and SEQ ID NO: 144. In some embodiments, the first polypeptide comprises the sequence of SEQ ID No. 282 (domain A, domain B, domain C, and domain D) conjugated to a complement modulator polypeptide comprising a sequence selected from the group consisting of SEQ ID Nos. 41, 42, and 72 (domain R); and wherein the second polypeptide comprises the sequence of SEQ ID No. 279 (domain E and domain F). In some embodiments, the first polypeptide comprises the sequence of SEQ ID No. 282 (domain A, domain B, domain C, and domain. D); and wherein the second polypeptide comprises the sequence of SEQ ID No. 279 (domain E and domain F) conjugated to a complement modulator polypeptide comprising a sequence selected from the group consisting of SEQ ID No. 72 (domain R).

Another embodiment provides a pharmaceutical composition comprising a fusion protein construct according to any one of the above embodiments. Yet another embodiment provides a polynucleotide that encodes a fusion protein. Another embodiment provides a method of treatment comprising providing to a subject a therapeutically effective amount of a pharmaceutical composition.

In some embodiments, the subject suffers from a complement-mediated disease or a complement-mediated inflammation. In some embodiments, the fusion protein construct specifically binds to C3d with a KD affinity of $10^{-8}$ M or less, and the subject suffers from the complement-mediated disease, wherein the complement-mediated disease is characterized by an increased deposition of C3d. In some embodiments, the fusion protein construct specifically binds to C2 antibody-reactive phospholipid with a KD affinity of $10^{-8}$ M or less, and the subject suffers from a complement-mediated disease, wherein the complement-mediated disease is characterized by an increased deposition of C2 antibody-reactive phospholipid. In some embodiments, the subject suffers from the complement-mediated inflammation, wherein the complement mediated inflammation comprises an inflammatory fibrotic disease, and wherein the inflammatory fibrotic disease comprises focal segmental glomerulosclerosis, primary sclerosing cholangitis, or membranoproliferative glomerulonephritis. In some embodiments, the subject suffers from a complement-mediated auto-immune disease, comprising rheumatoid arthritis, systemic lupus erythematosus, lupus nephritis, or pemphigus vulgaris. In some embodiments, the subject suffers from a complement-mediated kidney disease, comprising membranoproliferative glomerulonephritis, or complement 3 glomerulopathy. In some embodiments, the subject suffers from a complement-mediated cardiovascular disease. In some embodiments, the cardiovascular disease comprises atherosclerosis or thrombosis. In some embodiments, the subject suffers from a complement-mediated dermatological disease.

In some embodiments, the dermatological disease comprises psoriasis, acne inversa, lupus erythematosus, cutaneous small vessel vasculitis, urticaria, urticarial vasculitis, or bullous pemphigoid. In some embodiments, the subject suffers from the complement-mediated inflammation, and wherein the complement-mediated inflammation is associated with a condition or disease selected from the group consisting of ischemia/reperfusion injury, burn injury, endotoxemia and septic shock, adult respiratory distress syndrome, cardiopulmonary bypass, hemodialysis, anaphylactic shock, asthma, angioedema, Crohn's disease, sickle cell anemia, glomerulonephritis, membranous nephritis, pancreatitis, transplant rejection, hyperacute xenograft rejection, recurrent fetal loss, preeclampsia, drug allergy, IL-2 induced vascular leakage syndrome, radiographic contrast media allergy, myasthenia gravis, Alzheimer's disease, multiple sclerosis, rheumatoid arthritis, systemic lupus erythematosus, insulin-dependent diabetes mellitus, acute disseminated encephalomyelitis, Addison's disease, antiphospholipid antibody syndrome, autoimmune hepatitis, Goodpasture's syndrome, Graves' disease, Guillain-Bane syndrome, Hashimoto's disease, idiopathic thrombocytopenic purpura, pemphigus, Sjogren's syndrome, Takayasu's arteritis, myocardial infarction, stroke, acute respiratory distress syndrome, sepsis, plasmapheresis, plateletpheresis, leukopheresis, extracorporeal membrane oxygenation, heparin-induced extracorporeal LDL precipitation, bowel inflammation, urticarial, vasculitis, and lupus nephritis.

In some embodiments, the subject suffers from a condition or disease selected from the group consisting of ischemia-reperfusion injury, rheumatoid arthritis (RA), lupus nephritis, ischemic-reperfusion injury, atypical hemolytic uremic syndrome (aHUS), typical or infectious hemolytic uremic syndrome (tHUS), dense deposit disease (DDD), paroxysmal nocturnal hemoglobinuria (PNH), multiple sclerosis (MS), macular degeneration, hemolysis, elevated liver enzymes, and low platelets (HELLP) syndrome, sepsis, dermatomyositis, diabetic retinopathy, thrombotic thrombocytopenic purpura (TIP), spontaneous fetal loss, Pauci-immune vasculitis, epidermolysis bullosa, recurrent fetal loss, multiple sclerosis (MS), traumatic brain injury, a cardiovascular disorder, myocarditis, a cerebrovascular disorder, a peripheral vascular disorder, a renovascular disorder, a mesenteric/enteric vascular disorder, revascularization to transplants and/or replants, vasculitis, Henoch-Schönlein purpura nephritis, systemic lupus erythematosus-associated vasculitis, vasculitis associated with rheumatoid arthritis, immune complex vasculitis, Takayasu's disease, capillary leak syndrome, dilated cardiomyopathy, diabetic angiopathy, thoracic-abdominal aortic aneurysm, Kawasaki's disease (arteritis), venous gas embolus (VGE), and restenosis following stent placement, rotational atherectomy, percutaneous transluminal coronary angioplasty (PTCA), myasthenia gravis, cold-agglutinin disease (CAD), paroxysmal cold hemoglobinuria (PCH), dermatomyositis, scleroderma, warm autoimmune hemolytic anemia, Graves' disease, Hashimoto's thyroiditis, type I diabetes, psoriasis, pemphigus, autoimmune hemolytic anemia (AIHA), idiopathic thrombocytopenic purpura (ITP), Goodpasture's syndrome, antiphospholipid syndrome (APS), Degos disease, and catastrophic APS (CAPS).

In some embodiments, the subject suffers from a condition or disease selected from the group consisting of age-related macular degeneration (AMD), type II membranoproliferative glomerulonephritis (MPGN II), hemolytic uremic syndrome (HUS), asthma, amyloidosis, and thrombotic thrombocytopenic purpura. In some embodiments, the hemolytic uremic syndrome (HUS) is an atypical hemolytic uremic syndrome (aHUS). In some embodiments, the subject suffers from a drusen-associated disease or a drusen-related disease. In some embodiments, the drusen-related disease is amyloidosis, elastosis, dense deposit disease, glomerulonephritis, atherosclerosis or an ocular drusen-related disease.

Another embodiment provides a pharmaceutical composition comprising a tetravalent fusion protein construct for modulating complement activity, the tetravalent fusion protein construct comprising: (i) an antibody or an antigen binding fragment thereof that binds a complement-associated antigen; and (ii) a first complement modulator peptide and a second complement modulator peptide, wherein the first and second complement modulator polypeptides can be the same or different.

In some embodiments, the at least one of the first and second complement modulator peptides is conjugated to the antibody or antigen binding fragment by a linker.

Another embodiment provides a pharmaceutical composition comprising a trivalent fusion protein construct for modulating complement activity, the tetravalent fusion protein construct comprising: (i) an antibody or an antigen binding fragment thereof that binds a complement-associated antigen; and (ii) one complement modulator peptide.

In some embodiments, the antibody or an antigen binding fragment thereof and the complement modulator peptide can be conjugated by a linker.

Another embodiment provides a pharmaceutical composition comprising a trivalent fusion protein construct for modulating complement activity, the trivalent fusion protein construct comprising: (i) a Fab that binds a complement-associated antigen; (ii) an antibody Fc domain; and (iii) a complement modulator peptide conjugated to the Fab or the Fc domain.

In some embodiments, the Fab or the Fc domain and the complement modulator peptide can be conjugated by a linker.

Another embodiment provides a pharmaceutical composition comprising a trivalent fusion protein construct comprising: a) a first polypeptide monomer comprising an antibody CH2 or CH3 domain, wherein the domain has at least one orthogonal modification that favors formation of a heterodimer as compared to a homodimer; b) a second polypeptide monomer comprising an antibody CH2 or CH3 domain, wherein the domain has at least one orthogonal modification that favors formation of a heterodimer with the first polypeptide monomer as compared to a homodimer; and wherein one of the first and second polypeptide further comprises a complement modulator peptide, and wherein the trivalent fusion protein construct binds a complement-associated antigen.

In some embodiments, the first polypeptide comprises a knob modification, and wherein the second polypeptide comprises a hole modification. In some embodiments, the first and second polypeptides comprise modifications resulting in charge or surface complementarity. In some embodiments, the complement modulator peptide is connected to one of the first and second polypeptide by an amino acid linker.

Another embodiment provides a pharmaceutical composition comprising a fusion protein construct that comprises: an antibody or an antigen-binding fragment thereof comprising (i) three heavy chain complementarity determining regions (CDRs) having the amino acid sequences of SEQ ID NOs; 11, 12 and 13; 17, 18 and 19; 23, 24 and 25; 29, 30 and 31; 35, 36 and 37; 147, 148, and 149; 188, 189, and 190; 196, 197, and 198; 204 or 343, 205, and 206; 212, 213, and 214; 220, 221, and 222; 228, 229, and 230; 29, 259 and 31; or 29, 260 and 31; residues 26-33 (CDR-H1), 51-58 (CDR-H2), and 97-100 (CDR-H3) of SEQ ID Nos. 280, 281, 282, 284, 285, 286, 73, or 288; residues 26-33 (CDR-H1), 51-58 (CDR-H2), and 97-102 (CDR-H3) of SEQ ID No. 244; or residues 26-33 (CDR-H1), 51-58 (CDR-H2), and 97-110 (CDR-H3) of SEQ ID No. 290 or (ii) three heavy chain CDRs having amino acid sequences that differ by a single conservative amino acid substitution within one of SEQ ID NOs: 11, 12 and 13; 17, 18 and 19; 23, 24 and 25; 29, 30 and 31; 35, 36 and 37; 147, 148, and 149; 188, 189, and 190; 196, 197, and 198; 204 or 343, 205, and 206; 212, 213, and 214; 220, 221, and 222; 228, 229, and 230; 29, 259 and 31; or 29, 260 and 31; residues 26-33 (CDR-H1), 51-58 (CDR-H2), and 97-100 (CDR-H3) of SEQ ID Nos. 280, 281, 282, 284, 285, 286, 73, or 288; residues 26-33 (CDR-H1), 51-58 (CDR-H2), and 97-102 (CDR-H3) of SEQ ID No. 244; or residues 26-33 (CDR-H1), 51-58 (CDR-H2), and 97-110 (CDR-H3) of SEQ ID No. 290 and (ii) three light chain complementarity determining regions (CDRs) having the amino acid sequences of SEQ II) NOs: 14, 15 and 16; 20, 21 and 22; 26, 27 and 28; 32, 33 and 34; 38, 39, and 40; 150, 151, and 152; 191, 192, and 193; 199, 200, and 201; 207, 208, and 209; 215, 216, and 217;223, 224 and 225; or 231, 232, and 233; residues 27-37 (CDR-L1), 55-57 (CDR-L2), and 94-102 (CDR-L3) of SEQ ID Nos. 279, 68, 287, or 59; or residues 27-38 (CDR-L1), 56-58 (CDR-L2), 95-102 (CDR-L3) of SEQ ID No. 289 or (ii) three light chain CDRs having amino acid sequences that differ by a single conservative amino acid substitution within one of SEQ ID NOs 14, 15 and 16; 20, 21 and 22; 26, 27 and 28; 32, 33 and 34; 38, 39, and 40; 150, 151, and 152; 191, 192, and 193; 199, 200, and 201; 207, 208, and 209; 215, 216, and 217;223, 224 and 225; or 231, 232, and 233; residues 27-37 (CDR-L1), 55-57 (CDR-L2), and 94-102 (CDR-L3) of SEQ ID Nos. 279, 68, 287, or 59; or residues 27-38 (CDR-L1), 56-58 (CDR-L2), 95-102 (CDR-L3) of SEQ ID No. 289 and a complement modulator peptide.

Another embodiment provides a pharmaceutical composition comprising a fusion protein construct that comprises: an antibody or an antigen-binding fragment thereof comprising (a) a heavy chain variable region comprising the amino acid sequence of at least one of SEQ ID Nos: 54, 58, 67, 73, 74, 81, 88, 89, 98, 99, 112, 145, 153, 194, 202, 210, 218, 226, 234, 238, 243, 244, 246, 247, 248, 249, 250, 251, 252, 253, 254, 255, 261, 262, 263, 264, 265, 270, 271, 272, 273, 274, 280, 281, 282, 283, 284, 285, 286, 288, 290, and 342; and (b) a light chain variable region comprising the amino acid sequence of at least one of SEQ ID Nos: 45, 59, 68, 195, 203, 211, 219, 227, 235, 256, 257, 258, 266, 267, 268, 269, 275, 276, 277, and 278, 279, 287, and 289, or (c) a heavy chain variable region comprising an amino acid sequence that differs by a one or more conservative amino acid substitution within at least one of SEQ ID Nos: 54, 58, 67, 73, 74, 81, 88, 89, 98, 99, 112, 145, 153, 194, 202, 210, 218, 226, 234, 238, 243, 244, 246, 247, 248, 249, 250, 251, 252, 253, 254, 255, 261, 262, 263, 264, 265, 270, 271, 272, 273, 274, 280, 281, 282, 283, 284, 285, 286, 288, 290, and 342; and (d) a light chain variable region comprising an amino acid sequence that differs by one or more conservative amino acid substitution within at least one of SEQ ID Nos: 45, 59, 68, 195, 203, 211, 219, 227, 235, 256, 257, 258, 266, 267, 268, 269, 275, 276, 277, and 278, 279, 287, and 289.

Another embodiment provides a pharmaceutical composition comprising a fusion protein construct that comprises a sequence selected from the group consisting of: SEQ ID NOs: 45, 51, 54, 58, 59, 62, 64, 67, 68, 73, 74, 79, 75, 81, 88, 89, 98, 99, 112, 121, 194, 195, 202, 203, 210, 211, 218, 219, 237, 226, 226, 227, 234, 235, 238, 239, 240, 243, 244, 245, 246, 247, 248, 249, 250, 251, 252, 253, 254, 255, 256, 257, 258, 261, 262, 263, 264, 265, 266, 267, 268, 269, 270, 271, 272, 273, 274, 275, 276, 277, and 278, 279, 280, 281, 282, 283, 284, 285, 286, 287, 288, 289, 290, and 342; and a complement modulator peptide.

In some embodiments, the complement modulator peptide is connected to the antibody or an antigen binding fragment thereof by an amino acid linker. In some embodiments, the amino acid linker comprises the amino acid sequence of any of SEQ ID NO: 138, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO; 177, SEQ ID NO: 178, SEQ ID NO: 179, SEQ ID NO: 180, SEQ ID NO: 181, SEQ ID NO: 182, SEQ ID NO: 183, SEQ ID NO: 241, or SEQ ID NO: 242. In some embodiments, the pharmaceutical composition comprises the antigen-binding fragment, wherein the antigen-binding fragment comprises an Fv fragment, Fab, Fab', F(ab')$_2$, or an scFv. In some embodiments, the fusion protein construct modulates alternative complement activity in a subject upon administration of the pharmaceutical composition to the subject. In some embodiments, the antibody or an antigen-binding fragment thereof or the Fab binds a domain of a mammalian annexin protein. In some embodiments, the antibody or an antigen-binding fragment thereof or the Fab binds a domain of a mammalian annexin protein with a KD affinity of $10^{-8}$M or less. In some embodiments, the domain is an annexin core domain. In some embodiments, the annexin core domain comprises an alpha-helical domain. In some embodiments, the annexin core domain comprises a calcium binding site and a membrane binding site. In some embodiments, the annexin core domain comprises at least one annexin repeat sequence. In some embodiments, the antibody or antigen-binding fragment thereof or the Fab binds the at least one annexin repeat sequence.

In some embodiments, the complement-associated antigen comprises a phospholipid, and wherein the antibody or an antigen-binding fragment thereof or the Fab binds the phospholipid. In some embodiments, the antibody or an antigen-binding fragment thereof or the Fab binds the phospholipid with a KD affinity of $10^{-8}$M or less. In some embodiments, the phospholipid is selected from the group consisting of phosphatidylethanolamine (PE), cardiolipin (CL), phosphatidylcholine (PC) and malondialdehyde (MDA). In some embodiments, the complement-associated antigen comprises a C3 complement protein or a fragment thereof, and wherein the antibody or antigen binding fragment thereof or the Fab binds the C3 complement protein or a fragment thereof. In some embodiments, the antibody or an antigen-binding fragment thereof or the Fab binds the C3 complement protein or a fragment thereof KD affinity of $10^{-8}$M or less. In some embodiments, the C3 complement protein fragment is C3d. In some embodiments, the complement modulator peptide comprises complement receptor 1 (CR1) protein. In some embodiments, the complement modulator peptide comprises domain A of the CR1 protein or a fragment thereof that retains at least three short consensus repeats (SCRs) of domain A. In some embodiments, the complement modulator peptide comprises domain B of the CR1 protein or a fragment thereof that retains at least three SCRs of domain B.

In some embodiments, the complement modulator peptide comprises domain C of the CR1 protein or a fragment thereof that retains at least three SCRs of domain C. In some embodiments, the pharmaceutical composition further comprises domain D of the CR1 protein or a fragment thereof that retains at least three SCRs of domain D. In some embodiments, the complement modulator peptide comprises first three SCRs of domain A, first three SCRs of domain B, and first three SCRs of domain C of the CR1 protein. In some embodiments, the CR1 protein is a human CR1 protein. In some embodiments, the complement modulator polypeptide is CR.1 (1-10). In some embodiments, the complement modulator polypeptide is CR1 (1-17). In some embodiments, the CR1 (1-10) comprises the amino acid sequence of SEQ ID NO: 41 or SEQ ID NO: 91, or a variant thereof with an amino acid sequence at least 85% identical. In some embodiments, the CR1 (1-17) comprises the amino acid sequence of SEQ ID NO: 42 or SEQ ID NO: 92, or a variant thereof with an amino acid sequence at least 85% identical. In some embodiments, the complement modulator peptide is a decay-accelerating factor (DAF) or a biologically active fragment thereof. In some embodiments, the DAF is a human DAF.

In some embodiments, the biologically active fragment of human DAF comprises at least one of a short consensus repeat (SCR) domain and an O-glycosylated serine/threonine-rich domain of a full-length human DAF. In some embodiments, the biologically active fragment of human DAF comprises SCR 1 to 4, or SCR 2 to 4 of a full-length human DAF. In some embodiments, the biologically active fragment of human DAF comprises the amino acid sequence of SEQ ID NO: 184, or a variant thereof with an amino acid sequence at least 85% identical. In some embodiments, the complement modulator peptide is factor H or a biologically active fragment thereof. In some embodiments, the factor H is a human factor H. In some embodiments, the biologically active fragment of human factor H comprises a stretch of amino acids selected from the group consisting of: amino acids 21-266, amino acids 21-320, amino acids 21-509 or amino acids 19-1106 of SEQ ID NO: 9, or a variant thereof with an amino acid sequence at least 85% identical to the stretch of amino acids. In some embodiments, the biologically active fragment of human factor H comprises one or more groups of short consensus repeats (SCRs) comprising SCRs 1 to 20, SCRs 1 to 2, SCRs 2 to 3, SCRs 3 to 4, SCRs 4 to 5, SCRs 5 to 6, SCRs 6 to 7, SCRs 7 to 8, SCRs 8 to 9, SCRs 9 to 10, SCRs 10 to 11, SCRs 11 to 12, SCRs 12 to 13, SCRs 13 to 14, SCRs 14 to 15, SCRs 15 to 16, SCRs 16 to 17, SCRs 17 to 18, SCRs 19 to 20 of a full-length human factor H, or any combination of SCRs 1 to 20.

In some embodiments, the biologically active fragment of human factor H comprises SCRs 1 to 4 of a full-length human factor H. In some embodiments, the biologically active fragment of human factor H comprises SCRs 1 to 5 of a full-length human factor H. In some embodiments, the biologically active fragment of human factor H comprises the amino acid sequence of SEQ ID NO: 72 or SEQ ID NO: 108, or a variant thereof with an amino acid sequence at least 85% identical. In some embodiments, the complement modulator peptide is MCP or a biologically active fragment thereof. In some embodiments, the MCP is a human MCP. In some embodiments, the biologically active fragment of human MCP comprises at least one of a short consensus repeat (SCR) domain of a full-length human MCP. In some embodiments, the biologically active fragment of human MCP comprises SCRs 3 to 4 of the full-length human. MCP. In some embodiments, the biologically active fragment of human MCP comprises the amino acid sequence of SEQ ID NO: 187, or a variant thereof with an amino acid sequence at least 85% identical.

In some embodiments, the complement modulator peptide is Map44 or a biologically active fragment thereof. In some embodiments, the Map44 is a human Map44. In some embodiments, the Map44 comprises the amino acid sequence of SEQ ID NO: 186, or a variant thereof with an amino acid sequence at least 85% identical. In some embodiments, the complement modulator peptide is CD59 or a biologically active fragment thereof. In some embodiments, the CD59 is a human. CD59. In some embodiments, the CD59 comprises the amino acid sequence of SEQ ID NO: 185, or a variant thereof with an amino acid sequence at least 85% identical. In some embodiments, the antibody or an antigen-binding fragment thereof is a human antibody or an antigen-binding fragment thereof. In some embodiments, the antibody or an antigen-binding fragment thereof is a humanized antibody or an antigen-binding fragment thereof.

Another embodiment provides a polynucleotide that encodes a fusion protein. Another embodiment provides a method of treatment comprising providing to a subject a therapeutically effective amount of a pharmaceutical composition. In some embodiments, the subject suffers from complement-mediated inflammation. In some embodiments, the complement-mediated inflammation comprises an inflammatory fibrotic disease, and wherein the inflammatory fibrotic disease comprises focal segmental glomerulosclerosis, primary sclerosing cholangitis, or membranoproliferative glomerulonephritis. In some embodiments, the subject suffers from a complement-mediated auto-immune disease, comprising rheumatoid arthritis, systemic lupus erythematosus, lupus nephritis, or pemphigus vulgaris. In some embodiments, the subject suffers from a complement-mediated kidney disease, comprising membranoproliferative glomerulonephritis, or complement 3 glomerulopathy. In some embodiments, the subject suffers from a complement-mediated cardiovascular disease. In some embodiments, the cardiovascular disease comprises atherosclerosis or thrombosis. In some embodiments, the subject suffers from a complement-mediated dermatological disease. In some embodiments, the dermatological disease comprises psoriasis, acne inversa, lupus erythematosus, cutaneous small vessel vasculitis, urticaria, urticarial vasculitis, and bullous pemphigoid.

In some embodiments, the complement-mediated inflammation is associated with a condition or disease selected from the group consisting of ischemia/reperfusion injury, burn injury, endotoxemia and septic shock, adult respiratory distress syndrome, cardiopulmonary bypass, hemodialysis, anaphylactic shock, asthma, angioedema, Crohn's disease, sickle cell anemia, glomerulonephritis, membranous nephritis, pancreatitis, transplant rejection, hyperacute xenograft rejection, recurrent fetal loss, preeclampsia, drug allergy, IL-2 induced vascular leakage syndrome, radiographic contrast media allergy, myasthenia gravis, Alzheimer's disease, multiple sclerosis, rheumatoid arthritis, systemic lupus erythematosus, insulin-dependent diabetes mellitus, acute disseminated encephalomyelitis, Addison's disease, antiphospholipid antibody syndrome, autoimmune hepatitis, Goodpasture's syndrome, Graves' disease, Guillain-Bane syndrome, Hashimoto's disease, idiopathic thrombocytopenic purpura, pemphigus, Sjogren's syndrome, Takayasu's arteritis, myocardial infarction, stroke, acute respiratory distress syndrome, sepsis, plasmapheresis, plateletpheresis, leukopheresis, extracorporeal membrane oxygenation, heparin-induced extracorporeal LDL precipitation, bowel inflammation, urticarial, and vasculitis and lupus nephritis.

In some embodiments, the subject suffers from a condition or disease selected from the group consisting of ischemia-reperfusion injury, rheumatoid arthritis (RA), lupus nephritis, ischemia-reperfusion injury, atypical hemolytic uremic syndrome (aHUS), typical or infectious hemolytic uremic syndrome (tHUS), dense deposit disease (DDD), paroxysmal nocturnal hemoglobinuria (PNH), multiple sclerosis (MS), macular degeneration, hemolysis, elevated liver enzymes, and low platelets (HELLP) syndrome, sepsis, dermatomyositis, diabetic retinopathy, thrombotic thrombocytopenic purpura (TTP), spontaneous fetal loss, Pauci-immune vasculitis, epidermolysis bullosa, recurrent fetal loss, multiple sclerosis (MS), traumatic brain injury, a cardiovascular disorder, myocarditis, a cerebrovascular disorder, a peripheral vascular disorder, a renovascular disorder, a mesenteric/enteric vascular disorder, revascularization to transplants and/or replants, vasculitis, Henoch-Schönlein purpura nephritis, systemic lupus erythematosus-associated vasculitis, vasculitis associated with rheumatoid arthritis, immune complex vasculitis, Takayasu's disease, capillary leak syndrome, dilated cardiomyopathy, diabetic angiopathy, thoracic-abdominal aortic aneurysm, Kawasaki's disease (arteritis), venous gas embolus (VGE), and restenosis following stent placement, rotational atherectomy, percutaneous transluminal coronary angioplasty (PTCA), myasthenia gravis, cold-agglutinin disease (CAD), paroxysmal cold hemoglobinuria (PCH), dermatomyositis, scleroderma, warm autoimmune hemolytic anemia, Graves' disease, Hashimoto's thyroiditis, type 1 diabetes, psoriasis, pemphigus, autoimmune hemolytic anemia (AIHA), idiopathic thrombocytopenic purpura (ITP), Goodpasture's syndrome, antiphospholipid syndrome (APS), Degos disease, and catastrophic APS (CAPS).

In some embodiments, the subject can suffer from a condition or disease selected from the group consisting of age-related macular degeneration (AMD), type II membranoproliferative glomerulonephritis (MPGN II), hemolytic uremic syndrome (HUS), asthma, amyloidosis, and thrombotic thrombocytopenic purpura. In some embodiments, the hemolytic uremic syndrome (HUS) is an atypical hemolytic uremic syndrome (aHUS). In some embodiments, the subject can suffer from a drusen-associated disease or a drusen-related disease. In some embodiments, the drusen-related disease can be amyloidosis, elastosis, dense deposit disease, glomerulonephritis, atherosclerosis or an ocular drusen-related disease.

An additional embodiment provides a fusion protein construct that binds a complement-associated antigen, the monomeric fusion protein construct comprising: a first polypeptide comprising: a domain A, and a domain B, arranged, from. N-terminus to C-terminus in an A-B orientation, a second polypeptide comprising: a domain E, and a domain F, arranged, from N-terminus to C-terminus in an E-F orientation, wherein at least one of domain A and domain E can be conjugated to a domain R, and wherein: domain A can comprise a heavy chain variable region amino acid sequence (VH), or an antigen-binding fragment thereof, domain B comprises a heavy chain CH1 constant region amino acid sequence, domain R comprises a complement modulator polypeptide, domain E can comprise a light chain variable region amino acid sequence (VL), or an antigen-binding fragment thereof, and domain F can comprise a light chain constant region amino acid sequence (CL1). In some embodiments, the first polypeptide comprises the domain A, the domain B, and the domain R, wherein the domains of the first polypeptide are arranged, from N-terminus to C-terminus, in an R-A-B orientation, and wherein the domain R and the domain A are conjugated. In some embodiments, the second polypeptide comprises the domain E, the domain F, and the domain. R, wherein the domains of the second polypeptide are arranged, from N-terminus to C-terminus, in an R-E-F orientation, and wherein the domain E and the domain R are conjugated.

Another embodiment provides a fusion protein construct comprising: an antibody or an antigen binding fragment thereof that specifically binds to complement protein 3d (c3d), and two molecules of a complement modulator polypeptide, wherein each molecule of the complement modulator polypeptide comprises a biologically active fragment of a complement protein selected from the group consisting of: CR1, DAF, MCP, Crry, MAp44, MAp19, CD59, and factor H, wherein the fusion protein construct has a lower half-maximal inhibitory concentration, in a complement assay, compared to that of a comparator protein construct that does not comprise the antibody but is otherwise identical.

In some embodiments, the each molecule of the complement modulator polypeptide can be conjugated to a heavy chain of the antibody or the antigen binding fragment thereof. In some embodiments, the each molecule of the complement modulator polypeptide can be conjugated to the C terminus of the heavy chain.

In some embodiments, the antibody or the antigen binding fragment thereof can comprise a first polypeptide and a second polypeptide, wherein the first polypeptide can comprise a heavy chain sequence comprising the amino acid sequence of at least one of: SEQ ID NO: 54, SEQ ID NO: 58, SEQ ID NO: 60, SEQ ID NO: 61, SEQ ID NO: 64, SEQ ID NO: 65, SEQ ID NO: 67, SEQ ID NO: 69, SEQ ID NO: 70, SEQ ID NO: 71, SEQ ID NO: 73, SEQ ID NO: 74, SEQ ID NO: 75, SEQ ID NO: 76, SEQ ID NO: 78, SEQ ID NO: 80, SEQ ID NO: 81, SEQ ID NO: 82, SEQ ID NO: 85, SEQ ID NO: 87, SEQ ID NO: 88, SEQ ID NO: 132, SEQ ID NO: 133, SEQ ID NO: 134, SEQ ID NO: 243, SEQ ID NO: 282, SEQ ID NO: 284, SEQ ID NO: 285, and SEQ ID NO: 286; and the second polypeptide can comprise a light chain sequence comprising the amino acid sequence of at least one of SEQ ID NO: 59, SEQ ID NO: 68, SEQ ID NO: 77, SEQ ID NO: 79, SEQ ID NO: 84, SEQ ID NO: 86, SEQ ID NO: 135, and SEQ ID NO: 27.

In some embodiments, the first polypeptide can comprise at least two amino acid sequences selected from the group consisting of SEQ ID NO: 54, SEQ ID NO: 58, SEQ ID NO: 60, SEQ ID NO: 61, SEQ ID NO: 64, SEQ ID NO: 65, SEQ ID NO: 67, SEQ ID NO: 69, SEQ ID NO: 70, SEQ ID NO: 71, SEQ ID NO: 73, SEQ ID NO: 74, SEQ ID NO: 75, SEQ ID NO: 76, SEQ ID NO: 78, SEQ ID NO: 80, SEQ ID NO: 81, SEQ ID NO: 82, SEQ ID NO: 85, SEQ ID NO: 87, SEQ ID NO: 88, SEQ ID NO: 132, SEQ ID NO: 133, SEQ ID NO: 134, SEQ ID NO: 243, SEQ ID NO: 282, SEQ ID NO: 284, SEQ ID NO: 285, and SEQ ID NO: 286; and the second polypeptide can comprise at least two amino acid sequences selected from the group consisting of SEQ ID NO: 59, SEQ ID NO: 68, SEQ ID NO: 77, SEQ ID NO: 79, SEQ ID NO: 84, SEQ ID NO: 86, SEQ ID NO: 135, and SEQ ID NO: 279.

In some embodiments, the at least two amino acid sequences of the first polypeptide can be the same amino acid sequence, and the at least two amino acid sequences of the second polypeptide can be the same amino acid sequence. In some embodiments, the at least two amino acid sequences of the first polypeptide can be SEQ ID NO: 282 or SEQ ID NO: 285, and the at least two amino acid sequences of the second polypeptide can be SEQ ID NO: 279.

In some embodiments, the fusion protein construct further comprises a linker. In some embodiments the linker can comprise the amino acid sequence of any of SEQ ID NO: 138, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 241, or SEQ ID NO: 242.

In some embodiments, the complement protein is factor H or a biologically active fragment thereof. In some embodiments, the factor H or biologically active fragment thereof can comprise the amino acid sequence of SEQ ID NO: 72 or SEQ NO: 108, or a variant thereof with an amino acid sequence at least 85% identical.

In some embodiments, the complement protein is CR.1 or a fragment thereof. In some embodiments, the complement protein can comprise the amino acid sequence of SEQ ID NO: 41, SEQ ID NO: 42, SEQ ID NO: 91, or SEQ ID NO: 92, or a variant thereof with an amino acid sequence at least 85% identical.

In some embodiments, the fusion protein construct can comprise the amino acid sequence of at least one of SEQ ID NO: 41, SEQ ID NO: 42, SEQ ID NO: 43, SEQ ID NO: 44, SEQ ID NO: 46, SEQ II) NO: 47, SEQ ID NO: 48, SEQ ID NO: 49, SEQ II) NO: 50, SEQ ID NO: 52, SEQ ID NO: 53, SEQ ID NO: 54, SEQ ID NO: 55, SEQ ID NO: 56, SEQ ID NO: 57, SEQ ID NO: 60, SEQ ID NO: 61, SEQ ID NO: 63, SEQ ID NO: 65, SEQ ID NO: 66, SEQ ID NO: 69, SEQ ID NO: 70, SEQ ID NO: 71, SEQ ID NO: 72, SEQ ID NO: 75, SEQ ID NO: 76, SEQ ID NO: 77, SEQ ID NO: 78, SEQ ID NO: 79, SEQ ID NO: 80, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 90, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 109, SEQ ID NO: 110, SEQ ID NO: 111, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ED NO: 134, SEQ ID NO: 135, SEQ ID NO: 136, SEQ ID NO: 137, SEQ ID NO: 138, SEQ ID NO: 140, SEQ ID NO: 141, SEQ ID NO: 142, SEQ ID NO: 143, SEQ ID NO: 144, SEQ ID NO: 279, SEQ ID NO: 282, and SEQ ID NO: 285.

Another embodiment provides, a fusion protein construct comprising: an antibody or an antigen binding fragment thereof that specifically binds to a complement-associated antigen, wherein the antibody comprises a first polypeptide and a second polypeptide, wherein the first polypeptide and the second polypeptide each comprises a heavy chain, and a light chain; and a first molecule and a second molecule of a complement modulator polypeptide, wherein the first molecule and the second molecule each comprises a biologically active fragment of a complement protein selected from the group consisting of: CR1, DAF, MCP, Crry, MAp44, MAp19, CD59, and factor H, wherein upon administration of the fusion protein construct to a subject having a disease, an albumin to creatinine ratio in a urine sample from the subject having the disease is lower than an albumin to creatine ratio in a urine sample from a subject administered with a comparable fusion protein construct, wherein the comparable fusion protein construct does not comprise the antibody or the antigen binding fragment thereof but is otherwise identical In some embodiments, the disease is a complement-mediated kidney disease. In some embodiments, the complement-mediated kidney disease is a membranoproliferative glomerulonephritis or complement 3 glomerulopathy.

In some embodiments, the albumin to creatinine ratio in the urine sample from the subject having the disease can be at least about 1%, 2%, 3%, 5%, 10%, 15%, 20%, 25%, 30%, 35%, 40%, 45%, 50%, 55%, 60%, 65%, 70%, 75%, 80%, 85% lower (e.g., than in a subject administered with a comparable fusion protein construct).

Another embodiment provides a fusion protein construct that comprises: an antibody or an antigen-binding fragment thereof comprising: a heavy chain comprising the amino acid sequence of at least one of SEQ ID Nos: 54, 58, 60, 61, 64, 65, 67, 69, 70, 71, 73, 74, 75, 76, 78, 80, 81, 82, 85, 87, 88, 89, 98, 99, 112, 132, 133, 134, 145, 153, 194, 202, 210, 218, 226, 234, 238, 243, 244, 246, 247, 248, 249, 250, 251, 252, 253, 254, 255, 261, 262, 263, 264, 265, 270, 271, 272, 273, 274, 280, 281, 282, 283, 284, 285, 286, 288, 290, and 342; and a light chain comprising the amino acid sequence of at least one of SEQ ID Nos: 45, 59, 68, 77, 79, 84, 86, 135, 195, 203, 211, 219, 227, 235, 256, 257, 258, 266, 267, 268, 269, 275, 276, 277, 278, 279, 287, and 289; or a heavy chain comprising an amino acid sequence that differs by a one or more conservative amino acid substitution within at least one of SEQ ID Nos: 54, 58, 60, 61, 64, 65, 67, 69, 70, 71, 73, 74, 75, 76, 78, 80, 81, 82, 85, 87, 88, 89, 98, 99, 112, 132, 133, 134, 145, 153, 194, 202, 210, 218, 226, 234, 238, 243, 244, 246, 247, 248, 249, 250, 251, 252, 253, 254, 255, 261, 262, 263, 264, 265, 270, 271, 272, 273, 274, 280, 281, 282, 283, 284, 285, 286, 288, 290, and 342; and a light chain comprising an amino acid sequence that differs by one or more conservative amino acid substitution within at least one of SEQ ID Nos: 45, 59, 68, 77, 79, 84, 86, 135, 195, 203, 211, 219, 227, 235, 256, 257, 258, 266, 267, 268, 269, 275, 276, 277, 278, 279, 287, and 289.

In some embodiments, the fusion protein construct can further comprise a complement modulator polypeptide, wherein the complement modulator polypeptide comprises at least one of complement receptor 1 (CR1) protein, DAF, MCP, Crry, MAp44, MAp19, CD59, factor H, and biologically active fragments thereof.

INCORPORATION BY REFERENCE

All publications, patents, patent applications, and NCBI accession numbers mentioned in this specification are herein incorporated by reference to the same extent as if each individual publication, patent, or patent application was specifically and individually indicated to be incorporated by reference, and as if set forth in their entireties. In the event of a conflict between a term as used herein and the term as defined in the incorporated reference, the definition of this disclosure controls.

BRIEF DESCRIPTION OF THE DRAWINGS

The novel features of the disclosure are set forth with particularity in the appended claims. A better understanding of the features and advantages of this disclosure will be obtained by reference to the following detailed description that sets forth illustrative embodiments, in which the principles of this disclosure are utilized, and the accompanying drawings of which:

FIG. 21 discloses SEQ ID NOS 301-341 on the x-axis of the graph, respectively, in order of appearance and the sequence "NLDVSLQLPS" as SEQ ID NO: 299.

FIG. 22 discloses SEQ ID NOS 301-341 on the x-axis of the graph, respectively, in order of appearance and the sequence "NLDVSLQLPS" as SEQ ID NO: 299.

FIG. 23 illustrates recognition of an epitope on the C-terminus of C3dg by exemplary anti-C3d antibody 3d9a. FIG. 23 discloses SEQ ID NOS 301-341 on the x-axis of the graph, respectively, in order of appearance and the sequence "NLDVSLQLPS" as SEQ ID NO: 299.

FIG. 24 discloses SEQ ID NOS 301-341 on the x-axis of the graph, respectively, in order of appearance.

FIG. 25 discloses SEQ ID NOS 301-341 on the x-axis of the graph, respectively, in order of appearance FIGS. 26A-26L illustrates exemplary designs for C2-complement modulator (CR1) fusion protein constructs of this disclosure. FIG. 26A shows a fusion protein construct comprising a CR1 (1-10) polypeptide and an exemplary C2-scFv, wherein the CR1 (1-10) polypeptide is connected to the C-terminus of the light chain variable domain of the exemplary C2-scFv. FIG. 26B shows a fusion protein construct comprising a Crry polypeptide and an exemplary C2-scFv, wherein the Crry polypeptide is connected to the C-terminus of the light chain variable domain of the exemplary C2-scFv. FIG. 26C shows a fusion protein construct comprising a Crry polypeptide and an exemplary C2-Fab, wherein the Crry polypeptide is connected to the C-terminus of the heavy chain of the exemplary C2-Fab. FIG. 26D shows a fusion protein construct comprising a CR1 (1-10) polypeptide and an exemplary C2-Fab, wherein the CR1 (1-10) polypeptide is connected to the N-terminus of the heavy chain of the exemplary C2-Fab. FIG. 26E shows a fusion protein construct comprising a CR1 (1-10) polypeptide and an exemplary C2-Fab, wherein the CR1 (1-10) is connected to the C-terminus of the heavy chain of the exemplary C2-Fab. FIG. 26F shows a fusion protein construct comprising a CR1 (1-17) polypeptide and an exemplary C2-Fab, wherein the CR1 (1-17) polypeptide is connected to the N-terminus of the heavy chain of the exemplary C2-Fab. FIG. 26G shows a fusion protein construct comprising a CR1 (1-17) polypeptide and an exemplary C2-Fab, wherein the CR1 (1-17) polypeptide is connected to the C-terminus of the heavy chain of the exemplary C2-Fab. FIG. 26H shows a fusion protein construct comprising a single CR1 (1-10) polypeptide and an exemplary full-length C2-antibody, wherein the CR1 (1-10) is connected to the C-terminus of one of the heavy chains of the exemplary full-length C2-antibody, wherein the fusion protein construct comprises a knob-into-hole heterodimeric antibody construct. FIG. 26I shows a fusion protein construct comprising two CR1 (1-10) polypeptides and an exemplary full length C2-antibody, wherein each the C-terminus of each heavy chain of the exemplary full-length C2-antibody is connected to a single CR1 (10) polypeptide, wherein the fusion protein construct comprises a knob-into-hole heterodimeric antibody construct. FIG. 26J shows a fusion protein construct comprising a single CR1 (1-10) polypeptide and an exemplary C2-antibody fragment comprising a variable heavy region, a variable light region, and a constant region, wherein the single CR1 (10) polypeptide is connected to the N-terminus of the CH2-CH3 constant region of the exemplary C2-antibody fragment. FIG. 26K shows a fusion protein construct comprising a single CR1 (1-10) polypeptide and an exemplary full-length C2-antibody, wherein the single CR1 (10) polypeptide is connected to the N-terminus of one of the light chains of the exemplary full-length C2-antibody. FIG. 26L shows a fusion protein construct comprising a single CR1 (1-10) polypeptide and an exemplary full-length C2-antibody, wherein the single CR1 (10) polypeptide is connected to the N-terminus of one of the heavy chains of the exemplary full-length C2-antibody.

FIG. 27A shows a fusion protein construct comprising a Crry polypeptide and an exemplary antiC3d-Fab, wherein the Crry polypeptide is connected to the C-terminus of the heavy chain of the exemplary anti-C3d-Fab. FIG. 27B shows a fusion protein construct comprising a CR1 (1-10) polypeptide and an exemplary anti-C3d Fab, wherein the CR1 (1-10) polypeptide is connected to the C-terminus of the heavy chain of the exemplary anti-C3d Fab. FIG. 27C shows a fusion protein construct comprising factor H and an exemplary anti-C3d Fab, wherein the Factor H is connected to the C-terminus of the heavy chain of the exemplary anti-C3d Fab. FIG. 27D shows a fusion protein construct comprising a single factor H polypeptide and an exemplary full-length anti-C3d antibody, wherein the single factor H polypeptide is connected to the C-terminus of the heavy chain of the exemplary full-length anti-C3d antibody. FIG. 27E shows a fusion protein construct comprising two single factor H polypeptides and an exemplary full-length anti-C3d antibody, wherein the C-terminus of each heavy chain of the exemplary full-length anti-C3d antibody is connected to a single factor H polypeptide.

FIGS. 28A-28I illustrates exemplary designs for anti-C3d (3d8b)-complement modulator (CR1 or factor H) fusion protein constructs of this disclosure. FIG. 28A shows a fusion protein construct comprising a Crry polypeptide and an exemplary anti-C3d Fab, wherein the Crry is connected to the C-terminus of the heavy chain of the exemplary anti-C3d Fab. FIG. 28B shows a fusion protein construct comprising a CR1 (1-10) polypeptide and an exemplary anti-C3d Fab, wherein the CR1 (1-10) polypeptide is connected to the C-terminus of the heavy chain of the exemplary anti-C3d Fab. FIG. 28C shows a fusion protein construct comprising a factor H polypeptide and an exemplary anti-C3d Fab, wherein the factor H polypeptide is connected to the C-terminus of the heavy chain of the exemplary anti-C3d Fab. FIG. 28D shows a fusion protein construct comprising a single CR1 (1-10) polypeptide and an exemplary full-length anti-C3d antibody, wherein the single CR1 (1-10) polypeptide is connected to the C-terminus of one of the light chains of the exemplary full-length anti-C3d antibody. FIG. 28E shows a fusion protein construct comprising a single CR1 (1-10) polypeptide and an exemplary full-length anti-C3d antibody, wherein the single CR1 (1-10) polypeptide is connected to the C-terminus of one of the heavy chains of the exemplary full-length antibody. FIG. 28F shows a fusion protein construct comprising two CR1 (1-10) polypeptides and an exemplary full-length anti-C3d antibody, wherein the C-terminus of each heavy chain of the exemplary full-length anti-C3d antibody is connected to a single CR1 (1-10) polypeptide. FIG. 28G shows a fusion protein construct comprising a single factor H polypeptide and an exemplary full-length anti-C3d antibody, wherein the single factor H polypeptide is connected to the C-terminus of one of the heavy chains of the exemplary full-length anti-C3d antibody. FIG. 28H shows a fusion protein construct comprising two factor H polypeptides and an exemplary full-length anti-C3d antibody, wherein the C-terminus of each heavy chain of the exemplary full-length anti-C3d antibody is connected to a single factor H polypeptide.

FIG. 29A illustrates fH 1-5-3d8b heavy chain murine IgG1 (the complement modulator is connected to the N-terminus of the heavy chain via a linker). FIG. 29B illustrates 3d8b kappa light chain—fH$_{1-5}$ (the complement modulator is connected to the C-terminus of the light chain via a linker). FIG. 29C illustrates fH 1-5-3d8b kappa light chain (the complement modulator is connected to the N-terminus of the light chain via a linker).

FIG. 31A shows a fusion protein construct comprising one CR1 (1-17) polypeptide and an exemplary Fab fragment of the anti-C3d antibody 3d8b, wherein the C-terminus of the heavy chain of the exemplary Fab fragment is connected to the single CR1 (1-17) polypeptide. FIG. 31B shows a fusion protein construct comprising one CR1 (1-17) polypeptide and an exemplary full length anti-C3d 3d8b antibody, wherein the C-terminus of one of the heavy chains of the exemplary full-length anti-C3d 3d8b antibody is connected to the single CR1 (1-17) polypeptide. FIG. 31C shows a fusion protein construct comprising two CR1 (1-17) polypeptides and an exemplary full-length anti-C3d 3d8b antibody, wherein the C-terminus of each of the heavy chains of the exemplary full-length anti-C3d 3d8b antibody is connected to a single CR1 (1-17) polypeptide. FIG. 31D shows a fusion protein construct comprising two CR1 (1-17) polypeptides and an exemplary full-length anti-C3d 3d8b antibody, wherein the C-terminus of each of the light chains of the exemplary full-length anti-C3d 3d8b antibody is connected to a single CR1 (1-17) polypeptide. FIG. 31E shows a fusion protein construct comprising two CR1 (1-17) polypeptides and an exemplary full length anti-C3d 3d8b antibody, wherein the N-terminus of each of the heavy chains of the exemplary full-length anti-C3d 3d8b antibody is connected to a single CR1 (1-17) polypeptide. FIG. 31F shows a fusion protein construct comprising two CR1 (1-17) polypeptides and an exemplary full-length anti-C3d 3d8b antibody, wherein the N-terminus of each of the light chains of the exemplary full-length anti-C3d 3d8b antibody is connected to a single CR1 (1-17) polypeptide.

FIG. 32A shows the staining of glomerular C3 deposits in harvested kidneys measured by immunofluorescence (IF). FIG. 32 B shows the C3 deposits of harvested livers using IF.

FIG. 33A shows the staining of glomerular C3 deposits in harvested kidneys measured by IF. FIG. 33B shows the C3 deposits of harvested livers using F.

DETAILED DESCRIPTION

Figure 1:
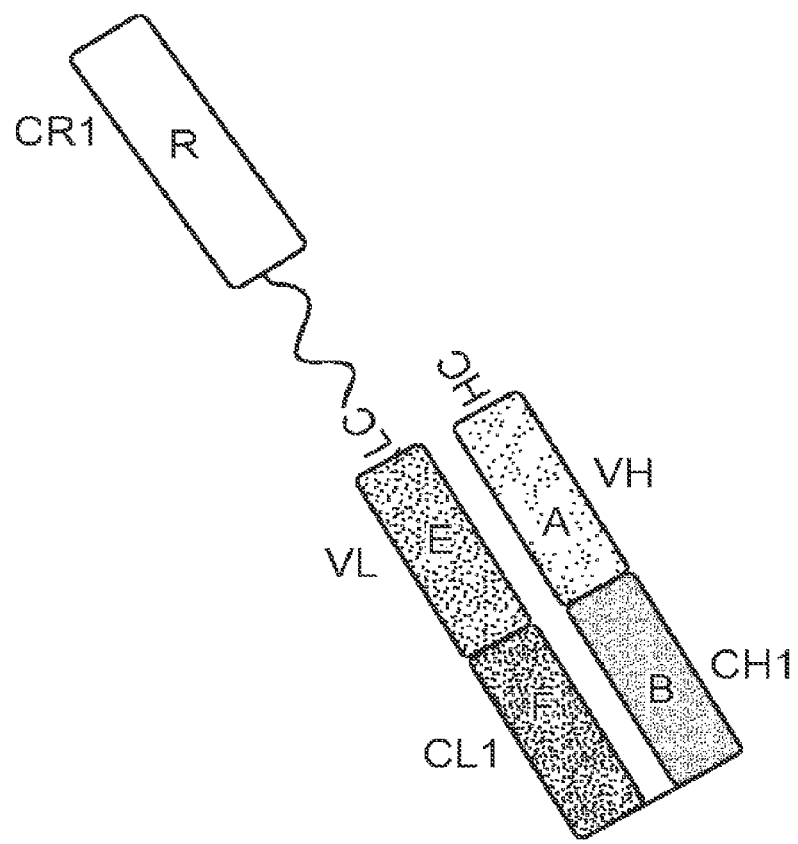
FIG. 1 illustrates an exemplary monomeric fusion protein construct of this disclosure, comprising a linkage between the light chain of a targeting moiety and a complement modulator polypeptide. The complement modulator polypeptide is connected to the N-terminus of the light chain via a linker.

This disclosure provides fusion protein constructs comprising an antibody or an antigen binding fragment thereof and two molecules of a complement modulator polypeptide. The antibody or antigen binding fragment thereof can specifically bind to a complement protein. The complement protein can be, for example, complement protein 3d (c3d). In some cases, a molecule of the complement modulator polypeptide can comprise at least a biologically active fragment of a complement protein. The complement protein can be, for example, CR1, DAF, MCP, Crry, MAp44, MAp19, CD59, or factor H. In some cases, the fusion protein construct has a lower half-maximal inhibitory concentration (based on for example a complement assay) compared to that of a comparator protein construct that does not comprise the antibody but is otherwise identical. In some cases, a molecule of the complement modulator polypeptide can be conjugated to a heavy chain of the antibody or the antigen binding fragment thereof. In some cases, a molecule of the complement modulator polypeptide can be conjugated to a light chain of the antibody or the antigen binding fragment thereof. In some cases, a molecule of the complement modulator polypeptide is conjugated to the C terminus of the heavy chain and/or the light chain. In some cases, a molecule of the complement modulator polypeptide is conjugated to the N terminus of the heavy chain and/or the light chain.

This disclosure provides a fusion protein construct comprising an antibody or an antigen binding fragment thereof that specifically binds to a complement-associated antigen, and a first molecule and a second molecule of a complement modulator polypeptide. In some case, the antibody can comprise a first polypeptide and a second polypeptide. In some cases, the first polypeptide and the second polypeptide can each comprise a heavy chain, and a light chain. In some cases, the first molecule and the second molecule can each comprise a biologically active fragment of a complement protein. The complement protein can be CR1, DAF, MCP, Crry, MAp44, MAp19, CD59, or factor H. In some cases, an albumin to creatine ratio can be measured in a biological sample from a subject. In some cases, the albumin to creatine ratio is determine at some point after administration of the fusion protein construct of this disclosure or after the administration of a comparable fusion protein construct. In some cases, the albumin to creatine ratio is compared between two or more biological samples from the same subject or from another subject. In some cases, the biological sample is a urine sample. In some cases, the subject has a disease disclosed in this disclosure. In some cases, the subject does not have a disease. In some cases, the albumin to creatinine ratio in a urine sample, after the administration of a fusion protein construct of this disclosure, from a subject having a disease (e.g., renal disease) is lower than an albumin to creatine ratio in a urine sample from a subject administered with a comparable fusion protein construct. In some cases, the comparable fusion protein construct does not comprise the antibody or the antigen binding fragment thereof but is otherwise identical to the fusion protein constructs of this disclosure.

This disclosure provides fusion protein constructs comprising at least two components that are fused to each other: (i) a targeting moiety that binds to a complement-associated antigen, and (ii) a complement modulator. The components of the construct can be fused to each other through covalent or non-covalent interactions. The fusion construct proteins can be engineered to optimize and tailor their target binding valency depending on the target, the condition and the amount of complement modulator desired. For example, the fusion protein constructs can be designed as bivalent, trivalent, or tetravalent, and each valency can relate to the target binding component or the complement modulator. When valency is used to describe the fusion protein construct, it is the sum of the valencies of each component. In some cases, the targeting moiety can be bivalent while the complement modulator is monovalent, providing a trivalent fusion protein construct. In certain other cases, the targeting moiety can be mono or bivalent while the complement modulator is bivalent, providing a trivalent or tetravalent fusion construct, respectively.

In addition, the targeting moiety within the fusion protein constructs can specifically bind to more than one antigen, thereby making the fusion protein construct a bispecific, trispecific, or multispecific molecule. The fusion protein constructs of the disclosure, armed with their increased specificity and increased valency, can bind to a plurality of targets. In certain examples, the fusion protein construct may have additional advantageous properties, such as suitability for production and pharmaceutical formulation due to their improved stability, low aggregation, pharmacokinetic and biological properties, or any combination thereof.

The targeting moiety can be an antibody or an antigen-binding fragment thereof that is capable of specifically binding one or more complement-associated antigens, such as, an antigen that is displayed locally on or near a site associated with complement activation Examples of the targeting moiety can include an antibody or an antigen binding fragment thereof specific for a domain of a mammalian annexin protein. Alternately, the targeting moiety can include an antibody or an antigen-binding fragment thereof specific for a phospholipid. The targeting moiety can include an antibody or an antigen-binding fragment thereof specific for a complement protein, such as a fragment of C3 associated with complement activation, e.g., C3b, iC3b, C3d and C3dg. It is also possible that targeting moiety is a bispecific or a trispecific antibody or antigen binding fragment thereof that is specific for any combinations of the following targets: a domain of a mammalian annexin protein, a phospholipid, and a complement protein, such as a fragment of C3, e.g., C3d, iC3b, C3d, C3dg, C3a, C3b, C3c or C3f. In addition, targeting moieties that are multivalent, such as trivalent, tetravalent, are also contemplated to be part of the fusion protein constructs described here.

Some examples of the fusion protein constructs can be trivalent, bispecific and comprise (i) a bivalent antibody or an antigen binding fragment thereof (e.g., an antibody Fab region); (ii) an antibody Fc domain; and (iii) a complement modulator fused to said antibody or antigen binding fragment thereof, or to said Fc domain. The bivalent antibody or an antigen-binding fragment thereof can be the targeting moiety of the trivalent, bispecific fusion protein construct and can bind to two molecules of a target, such as, a domain of a mammalian annexin protein (e.g., annexin IV, annexin-2), a phospholipid, a complement protein or a fragment of a complement protein (e.g., iC3b, C3d, C3dg, C3a, C3b, C3c or C3f). The complement modulator of the trivalent, bispecific fusion protein construct can be an inhibitor of complement activation. A further variant of a trivalent, bispecific fusion protein construct can comprise a bispecific trivalent heterodimeric polypeptide construct comprising a) a first polypeptide monomer comprising an antibody CH2 or CH3 domain, wherein said domain has at least one amino acid modification resulting in a cavity (also referred to as a "hole"); b) a second polypeptide monomer comprising an antibody CH2 or CH3 domain, wherein said domain has at least one amino acid modification resulting in a protuberance (also referred to as a "knob"); such that, upon heterodimerization of said first and second polypeptide monomers, said knob interacts with said hole; and wherein one of said first and second polypeptide is further fused to a complement modulator.

In another example, the fusion protein construct comprises a tetravalent construct for modulating complement activity, said tetravalent construct comprising: (i) a bivalent antibody or an antigen binding fragment thereof, and (ii) two complement modulators. The bivalent antibodies of the tetravalent fusion construct may be full length bivalent antibodies or antigen binding fragments thereof, e.g., variable region fragments, or a bivalent single chain variable fragment. The two complement modulators can be the same proteins or different, to form a bispecific tetravalent or a trispecific tetravalent fusion protein construct. In other examples, the fusion protein construct is monomeric and comprises one or more amino acid modifications that eliminate disulfide bonding that occurs in forming a homodimeric construct.

An antibody is composed of four polypeptides: two heavy chains and two light chains. The antigen binding portion of an antibody is formed by the light chain variable domain (VL) and the heavy chain variable domain (VH). At one extremity of these domains six loops form the antigen binding site, also referred to as the complementarity determining regions (CDR). Three CDRs are located on the VH domain (H1, H2 and H3) and the three others are on the VL domain (L1, L2 and L3). During B cell development a unique immunoglobulin region is formed by somatic recombination known as V(D)J recombination. The variable region of the immunoglobulin heavy or light chain is encoded by different gene segments. The heavy chain is encoded by three segments called variable (V), diversity (D) and joining (J) segments whereas the light chain variable is formed by the recombination of only two segments V and J. A large number of antibody paratopes (also referred to herein as antigen binding sites) can be generated by recombination between one of the multiple copies of the V, D and J segments that are present in the genome. The V segment encodes the CDR1 and CDR2 whereas the CDR3 is generated by the recombination events. During the course of the immune response further diversity introduced into the antigen binding site by a process called somatic hypermutation (SHM). During this process, point mutations are introduced in the variable genes of the heavy and light chains and in particular into the regions encoding the CDRs. This additional variability allows for the selection and expansion of B cells expressing antibody variants with improved affinity for their cognate antigen. The vast majority of immunoglobulins are bivalent and monospecific molecules carrying the same specificity on both arms as they are composed of two identical heavy chain polypeptides and two identical light chain polypeptides. However, it was recognized very early during the development of hybridoma technology that hybrid hybridomas can be created by a fusion event between two hybridomas (See, e.g., M. R. Suresh et al., Methods Enzymol 1986; 121: 210-228). These 'quadromas' express two different heavy and two different light chains and therefore produce a variety of different antibody species resulting from the random pairing of the heavy and light chains. Amongst these different species, bispecific antibodies (bsAbs) are generated, carrying a different specificity on each arm. Another naturally occurring exception is the immunoglobulin of the IgG4 isotype that can undergo heavy chain exchange due to a less stable dimerization mediated by the hinge region of that isotype (See, e.g., van der Neut Kolfschoten M et al., Science. 2007 317(5844):1554-7). Although this exchange seems to happen in vivo, its biological significance remains unclear. Monoclonal antibodies have emerged as a successful and attractive class of molecules for therapeutic intervention in several areas of human disease. However, targeting or neutralizing a single protein is not always sufficient to achieve efficacy in certain diseases which limits the therapeutic use of monoclonal antibodies. It is increasingly clear that in a number of indications neutralizing one component of a biological system is not sufficient to achieve efficacy. One solution to this problem is the co-administration of several monoclonal antibodies. This approach is however complicated by regulatory aspects if the antibodies to be combined have not been previously approved individually. Moreover, combination approaches are also costly from a manufacturing perspective. Accordingly, there exists a need for antibodies and therapeutics that enable targeting of multiple antigens with a single molecule.

This disclosure, which at least includes bi, tri, and tetravalent fusion protein constructs, provides molecules that have an improved therapeutic capability of addressing diseases, disorders, or conditions associated with the complement system.

Complement Modulator

The complement system is a major effector of humoral immunity and natural immunity. The complement system has three independent pathways of complement activation: a classical pathway, an alternative pathway, and a lectin pathway. While all three pathways differ with regard to initiating events, all three pathways converge with the cleavage of complement component C3. Key to the activity of the complement system is the covalent attachment of processed protein fragments derived from a serum protein, complement C3 and/or C4, to tissue sites of complement activation. This unusual property is due to the presence of a thioester bond in C3 that, when cleaved during C3 activation, converts C3 to a form designated C3b which can then utilize ester or amide bonds to link to cell and tissue-attached molecules. Once C3b is covalently attached, it is rapidly processed to the iC3b, C3dg and C3d forms, each of which remain covalently attached to the target tissue site. This process results in the "marking" of the tissue as one in which an inflammatory injury or other complement-related process is underway.

Complement can be activated by any of three pathways: the classical, lectin and alternative pathways. The classical pathway is activated through the binding of the complement system protein C1q to antigen-antibody complexes, pentraxins or apoptotic cells. The pentraxins include C-reactive protein and serum amyloid P component. The lectin pathway is initiated by binding of carbohydrates to mannose-binding lectin or by the binding of ficolins or collectins to carbohydrates or acetylated molecules.

The alternative pathway is activated on surfaces of pathogens that do not express or contain complement inhibitors. This results from the process termed 'tickover' of C3 that occurs spontaneously, involving the interaction of conformationally altered C3 with factor B, and results in the fixation of active C3b on pathogens or other surfaces. The alternative pathway can also be initiated when certain antibodies block endogenous regulatory mechanisms, by IgA-containing immune complexes, or when expression of complement regulatory proteins is decreased. In addition, the alternative pathway is activated by a mechanism called the 'amplification loop' when C3b that is deposited onto targets via the classical or lectin pathway, or indeed through the tickover process itself, binds factor B. See Muller-Eberhard (1988) Ann. Rev. Biochem. 57:321. For example, Holers and colleagues have shown that the alternative pathway is amplified at sites of local injury when inflammatory cells are recruited following initial complement activation. See Girardi et al., J. Clin. Invest. 2003, 112:1644. Dramatic complement amplification through the alternative pathway then occurs through a mechanism that involves either the additional generation of injured cells that fix complement, local synthesis of alternative pathway components, or more likely because infiltrating inflammatory cells that carry preformed C3 and properdin greatly increase activation specifically at that site.

Alternative pathway amplification is initiated when circulating factor B binds to activated C3b. This complex is then cleaved by circulating factor D to yield an enzymatically active C3 convertase complex, C3bBb. C3bBb cleaves additional C3 generating C3b, which drives inflammation and also further amplifies the activation process, generating a positive feedback loop. Factor H is a key regulator (inhibitor) of the alternative complement pathway activation and initiation mechanisms that competes with factor B for binding to conformationally altered C3 in the tickover mechanism and to C3b in the amplification loop. Binding of C3b to Factor H also leads to degradation of C3b by factor I to the inactive form iC3b (also designated C3bi), thus exerting a further check on complement activation. Factor H regulates complement in the fluid phase, circulating at a plasma concentration of approximately >400-600 µg/ml, but its binding to cells is a regulated phenomenon enhanced by the presence of a negatively charged surface as well as fixed C3b, iC3b, C3dg or C3d. See Jozsi et al., *Histopathol.* (2004) 19:251-258.

Complement activation, C3 fragment fixation and complement-mediated inflammation are involved in the etiology and progression of numerous diseases. The downregulation of complement activation has been shown to be effective in treating several diseases in animal models and in ex vivo studies, including, for example, systemic lupus erythematosus and glomerulonephritis (Y. Wang et al., *Proc. Nat'l Acad Sci. USA* (1996) 93:8563-8568), rheumatoid arthritis (Y. Wang et al., *Proc. Nat'l Acad Sci. USA* (1995) 92:8955-8959), cardiopulmonary bypass and hemodialysis (C. S. Rinder, *J. Clin. Invest*. (1995) 96:1564-1572), hyperacute rejection in organ transplantation (T. J. Kroshus et al., *Transplantation* (1995) 60:1194-1202), myocardial infarction (J. W. Homeister et al., *J. Immunol.* (1993) 150:1055-1064; H. F. Weisman et al., *Science* (1990) 249:146-151), ischemia/reperfusion injury (E. A. Amsterdam et al., *Am. J. Physical.* (1995) 268:H448-H457), antibody-mediated allograft rejection, for example, in the kidneys (J. B. Colvin, *J. Am. Soc. Nephrol.* (2007) 18(4):1046-56), and adult respiratory distress syndrome (R. Rabinovici et al., *J. Immunol.* (1992) 149:1744-1750). Moreover, other inflammatory conditions and autoimmune/immune complex diseases are also closely associated with complement activation (B. P. Morgan. *Eur. J. Clin. Invest*, (1994) 24:219-228), including, but not limited to, thermal injury, severe asthma, anaphylactic shock, bowel inflammation, urticaria, angioedema, vasculitis, multiple sclerosis, myasthenia gravis, myocarditis, membranoproliferative glomerulonephritis, atypical hemolytic uremic syndrome, Sjögren's syndrome, renal and pulmonary ischemia/reperfusion, and other organ-specific inflammatory disorders. It is currently uncertain whether complement activation is essential to the pathogenesis and injury of all diseases in which local tissue C3 activation and inflammatory injury occurs; nevertheless, C3 fragment fixation is frequently found as an associated event.

The endogenous membrane-bound proteins that control alternative pathway activation are decay-accelerating factor (DAF/CD55), membrane cofactor protein (MCP/CD46), and complement receptor 1 (CR1). Other endogenous proteins that control alternative pathway activation include Factor H, a circulating ~155 kDa glycoprotein that regulates alternative pathway activation in the fluid phase as well as on tissue surfaces. See J. J. Alexander et al., Mol. Immunol. (2006) 44: 123-132. Uncontrolled alternative pathway activation has been implicated in the pathogenesis of a diverse group of diseases, including age-related macular degeneration (AMD), atypical hemolytic uremic syndrome (aHUS), type II membranoproliferative glomerulonephritis (MPGN II), asthma, and renal ischemia/reperfusion (I/R) injury. See J. M. Thurman et al., J. Immunol. (2006) 176:1305-1310. Injury to host tissues by the alternative pathway indicates insufficient local control of the alternative pathway by the target tissue. Indeed, recent studies have demonstrated that mutations in CRPs are strong risk factors for aims (M. C. Pickering et al., J. Exp. Med. (2007) 204: 1249-1256) and MPGN II (R J. Smith et al., J. Am. Soc. Nephrol. (2007) 18:2447-2456), and functional polymorphisms in factor H, a circulating regulator of the alternative pathway, are associated with the development of AMD (R. J. Klein et al., Science (2005) 308:385-389; A. O. Edwards et al., Science (2005) 308:421-424; J. L. Haines et al., Science (2005) 308:419-421; G. S. Hageman et al., Proc. Nat'l Acad. Sci USA (2005) 102:7227-7232).

Ischemic acute kidney injury (AKI) in rodents (J. M. Thurman et al., J. Immunol. (2003) 170:1517-1523; J. M. Thurman et al., Am. Soc. Nephrol. (2006) 17:707-715) and in humans (J. M. Thurman et al., Kidney Int. (2005) 67:524-530) is associated with activation of the alternative pathway on the basolateral surface of injured tubular cells. It has been found that Complement receptor 1-related gene/protein y (Crry, a rodent analog of human MCP and CR1) is the only C-reactive protein (CRP) expressed by proximal tubular epithelial cells in mice, and that ischemia/reperfusion causes reduced surface expression of this protein. See J. M. Thurman et al., J. Clin. invest. (2006) 116:357-368. Mice with congenital deficiency of Crry (Crry+/−) are more sensitive than wild-type controls to ischemic acute renal failure (Id.), highlighting the importance of basolateral Crry for controlling the alternative pathway on this surface. It is not yet known whether polymorphisms or mutations in the CRPs may confer increased risk of developing MU in humans. Nevertheless, uncontrolled activation of the alternative pathway in the setting of reduced surface Crry indicates that circulating factor has a limited ability to protect the surface of hypoxic tubular epithelial cells.

Factor H circulates in high concentrations (>400-600 µg/ml) and is a potent inhibitor of the alternative complement pathway. See J. J. Alexander et al., Mol. Immunol. (2006) 44: 123-132. Alternative pathway inhibition on cell surfaces by factor H, however, requires that it properly bind to that surface. Several regions within the factor H protein bind to anionic surfaces, such as membranes rich in heparin sulfate or sialic acid, as well as to C3b on the surface. See S. Meri et al., Proc. Nat'l Acad. Sci USA (1990) 87:3982-3986; M. K. Pangburn et al., Immunol. (2000) 164:4742-4751. Activation of the alternative pathway on a particular surface is strongly influenced by the affinity of factor H for that surface. The polymorphisms and mutations associated with AMD and aHUS, respectively, most frequently involve the region of factor H required for binding anionic surfaces and not the complement regulatory region. See M. C. Pickering et al., J. Exp. Med. (2007) 204:1249-1256; A. P. Sjoberg et al., J. Biol. Chem. (2007) 282: 10894-10900. Thus, certain tissues or cell types require factor H to regulate alternative pathway activation on their surface. Different binding regions of the factor protein may be necessary for complement regulation on those tissues or cell types. In some cases, the binding of factor H to surfaces in particular tissues may be affected by other proteins. Identification of putative tissue-specific binding partners of factor H may provide potential mechanisms for modulating, i.e., stimulating or inhibiting, activity of the alternative complement pathway in different tissues.

Accordingly, the complement modulator protein of this disclosure can be a complement modulator protein or a complement modulator polypeptide (e.g., a complement inhibitor polypeptide) such as, e.g., a membrane cofactor protein (MCP) (SEQ ID NO: 1) (UniProtKB/Swiss-Prot. Accession No.

P15529), a decay accelerating factor (DAF), a CD59, a Crry, a CR1, a CR2, a factor H, or variants thereof, or fragments thereof. Additional complement modulators may include an anti-C5 antibody, eculizumab, pexelizumab, an anti-C3b antibody, an anti-C6 antibody, an anti-C7 antibody, an anti-C8 antibody, an anti-C9 antibody, an anti-factor B antibody, an anti-MASP antibody, an anti-factor D antibody, and an anti-properdin antibody, an anti-MBL antibody, Factor I, a linear peptide, a cyclic peptide, a compstatin or its analogs, N-acetylaspartylglutamic acid (NAAGA), and a biologically active fragment of any the preceding. In certain instances, the complement inhibitor can be a human complement inhibitor (e.g., a human MCP, a human DAF, a human CD59, a human CR1, a human Factor H, human Map44, human Map19, or another complement inhibitor derived from humans). In additional instances, the complement inhibitor can be a mammalian complement inhibitor (e.g., a mouse DAF, a mouse CD59 (also known as isoform A), a mouse CD59 isoform B, a mouse Crry, a mouse Factor H, a mouse Map44, a mouse Map19, or another complement inhibitor derived from mouse. Thus, the polypeptides can be human polypeptides or polypeptides of a non-human species. For example, the complement modulator polypeptides can be from a non-human primate (e.g., orangutan, chimpanzee, macaque, gorilla, lemur, or gibbon), horse, cow, pig, sheep, goat, dog, cat, or rodent (e.g., mouse, rabbit, hamster, gerbil, Guinea pig, or rat).

The complement modulator of the fusion protein construct can be a variant complement modulator. Variant complement modulator polypeptides, may contain one or more amino acid substitutions as compared to the corresponding wild-type sequence (e.g., no more than 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, nine, eight, seven, six, five, four, three, two, or one amino acid substitution compared to the wild type sequence). The amino acid substitutions can be conservative, non-conservative, or a mixture of both. Variant polypeptides may, in some embodiments, contain one or more deletions or additions, or a combination of one or more deletions, additions, and substitutions. In some examples, the variant complement modulator polypeptides can contain one or more amino acid deletions, additions, or substitutions per 100 amino acids of the polypeptide. In some examples where the complement modulator polypeptide comprises short consensus repeats (SCRs), variant polypeptides may contain no amino acid substitutions, deletions, or additions in the complement modulator polypeptide SCRs.

A variant complement modulator polypeptide can comprise an amino acid sequence that is at least 70 (e.g., at least 71, 72, 73, 74, 75, 76, 77, 78, 79, 80, 81, 82, 83, 84, 85, 86, 87, 88, 89, 90, 91, 92.93, 94, 95, 96, 97, 98, or 99) % identical to the corresponding wild-type amino acid sequence. Functional fragments of a complement modulator polypeptide or variant polypeptide described herein are shorter than the full-length polypeptides. A variant complement modulator polypeptide can comprise an amino acid sequence that is at least 90%, 95%, or 98% identical to one or more functional (biologically active) fragments or domains of a complement modulator polypeptide identified herein. Variant polypeptides, and functional fragments of wild-type proteins or variants, retain at least 50 (e.g., at least 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 or greater) % of a complement modulatory activity of the corresponding wild-type polypeptide.

A variant complement modulator polypeptide, or functional fragment of the complement modulator polypeptide, can have greater than 100% of the ability of the corresponding wild-type protein to modulate complement activity. Methods for detecting and/or quantifying complement activity are known in the art and described herein.

Other examples of sequences useful as complement modulators in this disclosure include one or more short consensus repeat (SCR) domains from one or more of the following complement-related proteins: Factor H; complement receptor 1; complement receptor 2; Factor B; DAF; and others. In some cases, 1, 2, 3, 4, 5, 6, 7, 8, 9, 10, 11, 12, 13, 14, 15, 16, or 17 SCR regions are incorporated in complement modulators described herein. In some cases, where the complement modulator polypeptide comprises a "membrane cofactor protein," "MCP," or "CD46," it can refer to a widely distributed C3b/C4b-binding cell surface glycoprotein which may inhibit complement activation on host cells and can serve as a cofactor for the factor I-mediated cleavage of C3b and C4b, including homologs thereof. MCP may belong to a family known as the regulators of complement activation ("RCA"). Family members may share certain structural features, comprising varying numbers of short consensus repeat (SCR) domains, which are typically between 60 and 70 amino acids in length. Beginning at its amino-terminus, MCP may comprise four SCRs, a serine/threonine/proline-enriched region, an area of undefined function, a transmembrane hydrophobic domain, a cytoplasmic anchor and a cytoplasmic tail. It is understood that species and strain variations exist for the disclosed peptides, polypeptides, and proteins, and that human MCP or biologically active fragments thereof can encompass all species and strain variations.

SEQ ID No. 1 represents an exemplary sequence for the full-length human MCP (see, e.g., UniProtKB/Swiss-Prot. Accession No. P15529). Amino acids 1-34 may correspond to the signal peptide, amino acids 35-343 may correspond to the extracellular domain, amino acids 344-366 may correspond to the transmembrane domain, and amino acids 367-392 may correspond to the cytoplasmic domain. In the extracellular domain, amino acids 35-96 may correspond to SCR 1, amino acids 97-159 may correspond to SCR 2, amino acids 160-225 may correspond to SCR 3, amino acids 226-285 may correspond to SCR 4, and amino acids 302-326 may correspond to the serine/threonine-rich domain. It is understood that species and strain variations exist for the disclosed peptides, polypeptides, and proteins, and that MCP or biologically active fragments thereof can encompass all species and strain variations. As used herein, the term "biologically active" fragment of MCP may refer to any soluble fragment lacking both the cytoplasmic domain and the transmembrane domain, including fragments comprising, consisting essentially of or consisting of 1, 2, 3, or 4 SCR domains, with or without the serine/threonine-rich domain, having some or all of the complement inhibitory activity of the full-length human MCP protein. In some embodiments, the complement inhibitor portion comprises full-length human MCP (amino acids 35-392 of SEQ ID NO: 1), the extracellular domain of human MCP (amino acids 35-343 of SEQ ID NO: 1), or SCRs 1-4 of human MCP (amino acids 35-285 of SEQ ID NO: 1).

In some cases, where the complement modulator polypeptide comprises a Decay accelerating factor, also referred to as CD55 (DAF/CD55) (SEQ ID NO: 2 and SEQ ID NO: 3), is membrane-bound glycoprotein, having a molecular weight of about 70 kiloDalton (kDa), which inhibits complement activation on host cells. Like several other complement regulatory proteins, DAF comprises several approximately 60 amino acid repeating motifs termed short consensus repeat (SCR).

As used herein, the term "decay accelerating factor," "DAF," or "CD55" refers to a seventy kilodalton ("kDa") membrane glycoprotein comprising four short consensus repeat (SCR) domains followed by a heavily O-glycosylated serine/threonine-rich domain at the C-terminus that elevates the molecule from the membrane surface, followed by a glycosylphosphatidylinositol ("GPI") anchor. DAF protects the cell surface from complement activation by dissociating membrane-bound C3 convertases that are required to cleave complement protein C3 and to amplify the complement cascade. DAF prevents assembly or accelerates decay of both the C3- and C5-convertases of the alternative and classical complement pathways.

SEQ ID No. 2 represents an exemplary sequence for the full-length human DAF (see, e.g., UniProtKB/Swiss-Prot. Accession No. P08173); SEQ ID NO: 3 represents an exemplary sequence for the full-length mouse DAF (see, e.g., UniProtKB/Swiss-Prot. Accession No. Q61475). In the human DAF sequence, amino acids 1-34 may correspond to the signal peptide, amino acids 35-353 may appear in the mature protein, and amino acids 354-381 may be removed from the polypeptide after translation. Within the mature protein, amino acids 35-96 may correspond to SCR 1, amino acids 96-160 may correspond to SCR 2, amino acids 161-222 may correspond to SCR 3, amino acids 223-285 may correspond to SCR 4, and amino acids 287-353 may correspond to the O-glycosylated serine/threonine-rich domain. The GPI anchor may be attached to human. DAF at a serine at position 353. In the mouse DAF sequence, amino acids 1-34 may correspond to the signal peptide, amino acids 35-362 may appear in the mature protein, and amino acids 363-390 may be removed from the polypeptide after translation. Within the mature protein, amino acids 35-96 may correspond to SCR 1, amino acids 97-160 may correspond to SCR 2, amino acids 161-222 may correspond to SCR 3, amino acids 223-286 may correspond to SCR 4, and amino acids 288-362 may correspond to the O-glycosylated serine/threonine-rich domain. The GPI anchor may be attached to mouse DAF at a serine at position 362. It is understood that species and strain variations exist for the disclosed peptides, polypeptides, and proteins, and that DAF or biologically active fragments thereof can encompass all species and strain variations. As used herein, the term "biologically active" fragment of DAF may refer to any fragment of DAF lacking a GPI anchor, the amino acid to which it is attached (e.g., Ser-353), or both, including any fragments of the full-length DAF protein comprising, consisting essentially of or consisting of 1, 2, 3, or 4 SCR domains, with or without the O-glycosylated serine/threonine-rich domain, having some or all the complement inhibitory activity of the full-length DAF protein.

SEQ ID No. 4 represents an exemplary sequence for the full-length human CD59 (see, e.g., UniProtKB/Swiss-Prot. Accession No. P13987); SEQ ID NO: 5 represents an exemplary sequence for the full-length mouse CD59, isoform A (see, e.g., UniProtKB/Swiss-Prot. Accession No. O55186); SEQ ID NO: 6 represents an exemplary sequence for the full-length mouse CD59, isoform B (see, e.g., UniProtKB/Swiss-Prot. Accession No. P58019). In the human CD59 sequence, amino acids 1-25 of SEQ ID NO: 4 may correspond to the leader peptide, amino acids 26-102 of SEQ ID NO: 4 may correspond to the mature protein, and amino acids 103-128 of SEQ ID NO:4 may be removed after translation. The GPI anchor may be attached to CD59 at an asparagine at position 102 of SEQ ID NO: 4. In isoform A of the mouse CD59 sequence, amino acids 1-23 of SEQ ID NO: 5 may correspond to the leader peptide, amino acids 24-96 of SEQ ID NO: 5 may correspond to the mature protein, and amino acids 97-123 of SEQ ID NO: 5 may be removed after translation. The GPI anchor may be attached to CD59 at a serine at position 96 of SEQ ID NO: 5. In isoform B of the mouse CD59 sequence, amino acids 1-23 of SEQ ID NO: 6 may correspond to the leader peptide, amino acids 24-104 of SEQ ID NO: 6 may correspond to the mature protein, and amino acids 105-129 of SEQ ID NO: 6 may be removed after translation. The GPI anchor may be attached to CD59 at an asparagine at position 104 of SEQ ID NO: 6. It is understood that species and strain variations exist for the disclosed peptides, polypeptides, and proteins, and that CD59 or biologically active fragments thereof can encompass all species and strain variations. As used herein, the term "biologically active" fragment of human CD59 can refer to any fragment of human CD59 lacking a GPI anchor, the amino acid to which it is attached (e.g., Asn-102), or both, including any fragments of the full-length human CD59 protein having some or all the complement inhibitory activity of the full-length CD59 protein; and the term "biologically active" fragment of mouse CD59 can refer to any fragment of mouse CD59 isoform A or isoform B lacking a GPI anchor and/or the amino acid to which it is attached (e.g., Ser-96 of isoform A, or Asp-104 of isoform B), including any fragments of either full-length mouse CD59 protein isoform having some or all the complement inhibitory activity of the full-length CD59 protein.

SEQ ID No. 7 represents an exemplary sequence for the full-length mouse Crry protein. Amino acids 1-40 may correspond to the leader peptide, amino acids 41-483 of SEQ ID NO: 7 may correspond to the mature protein, comprising amino acids 41-405 of SEQ ID NO: 7, that may correspond to the extracellular domain, amino acids 406-426 of SEQ ID NO: 7, that may correspond to the transmembrane domain, and amino acids 427-483 of SEQ ID NO: 7, that may correspond to the cytoplasmic domain. In the extracellular domain, amino acids 83-143 of SEQ ID NO: 7 may correspond to SCR 1, amino acids 144-205 of SEQ ID NO: 7 may correspond to SCR 2, amino acids 206-276 of SEQ ID NO: 7 may correspond to SCR 3, amino acids 277-338 of SEQ ID NO: 7 may correspond to SCR 4, and amino acids 339-400 of SEQ ID NO: 7 may correspond to SCR 5. It is understood that species and strain variations exist for the disclosed peptides, polypeptides, and proteins, and that mouse Crry protein or biologically active fragments thereof can encompasses all species and strain variations. As used herein, the term "biologically active" fragment of mouse Crry protein can refer to any soluble fragment of mouse Crry lacking the transmembrane domain and the cytoplasmic domain, including fragments comprising, consisting essentially of or consisting of 1, 2, 3, 4, or 5 SCR domains, including any fragments of the full-length mouse Crry protein having some or all the complement inhibitory activity of the full-length Crry protein.

As used herein, the term "complement receptor 1," "CR1," or "CD35" can refer to a human gene encoding a protein of 2039 amino acids, with a predicted molecular weight of 220 kilodaltons ("kDa"), including homologs thereof. The gene can be expressed principally on erythrocytes, monocytes, neutrophils, and B cells, but may also be present on some T lymphocytes, mast cells, and glomerular podocytes. CR1 protein can be typically expressed at between 100 and 1000 copies per cell. CR1 can be the main system for processing and clearance of complement-opsonized immune complexes. CR1 can negatively regulate the complement cascade, mediate immune adherence and phagocytosis, and inhibit all complement pathways. The full-length CR1 protein may comprise a 42 amino acid signal peptide, an extracellular domain of 1930 amino acids, a 25 amino acid transmembrane domain, and a 43 amino acid C-terminal cytoplasmic domain. The extracellular domain of CR1 can include 25 potential N-glycosylation signal sequences and may comprise 30 short consensus repeat ("SCR") domains, also known as complement control protein (CCP) repeats, or sushi domains, each 60 to 70 amino acids long. The sequence homology between SCRs can range between 60-99 percent. The 30 SCR domains may further be grouped into four longer regions termed long homologous repeats ("LHRs"), each encoding approximately 45 kDa segments of the CR1 protein, designated LHR-A, -B, -C, and -D (see, e.g., Krych-Goldberg et al., 274(44): 31160-31168, 1999). The first three LHRs can comprise seven SCR domains each, while LHR-D can comprise 9 SCR domains. The active sites on the extracellular domain of CR1 protein can include a C4b-binding site with lower affinity for C3b in SCR 1-3 comprising amino acids 42-234. a C3b-binding site with lower affinity for C4b in SCRs 8-11 comprising amino acids 490-745, a C3b-binding site with lower affinity for C4b in SCRs 15-18 comprising amino acids 940-1196, and a C1q-binding site in SCRs 22-28 comprising amino acids 1394-1842.

SEQ ID No. 8 represents an exemplary sequence for the full-length human CR1 (see, e.g., UniProtKB/Swiss-Prot. Accession No. P17927). Amino acids 1-41 may correspond to the signal peptide, amino acids 42-2039 may correspond to the mature protein, comprising amino acids 42-1971, that may correspond to the extracellular domain, amino acids 1972-1996, that may correspond to the transmembrane domain, and amino acids 1997-2039, that may correspond to the cytoplasmic domain. In the extracellular domain, amino acids 42-101 may correspond to SCR 1, 102-163 may correspond to SCR 2, amino acids 164-234 may correspond to SCR 3, amino acids 236-295 may correspond to SCR 4, amino acids 295-355 may correspond to SCR 5, amino acids 356-418 may correspond to SCR 6, amino acids 419-489 may correspond to SCR 7, amino acids 491-551 may correspond to SCR 8, amino acids 552-613 may correspond to SCR 9, amino acids 614-684 may correspond to SCR 10, amino acids 686-745 may correspond to SCR 11, amino acids 745-805 may correspond to SCR 12, amino acids 806-868 may correspond to SCR 13, amino acids 869-939 may correspond to SCR 14, amino acids 941-1001 may correspond to SCR 15, amino acids 1002-1063 may correspond to SCR 16, amino acids 1064-1134 may correspond to SCR 17, amino acids 1136-1195 may correspond to SCR 18, amino acids 1195-1255 may correspond to SCR 19, amino acids 1256-1318 may correspond to SCR 20, amino acids 1319-1389 may correspond to SCR 21, amino acids 1394-1454 may correspond to SCR 22, amino acids 1455-1516 may correspond to SCR 23, amino acids 1517-1587 may correspond to SCR 24, amino acids 1589-1648 may correspond to SCR 25, amino acids 1648-1708 may correspond to SCR 26, amino acids 1709-1771 may correspond to SCR 27, amino acids 1772-1842 may correspond to SCR 28, amino acids 1846-1906 may correspond to SCR 29, amino acids 1907-1967 may correspond to SCR 30. It is understood that species and strain variations exist for the disclosed peptides, polypeptides, and proteins, and that CR1 protein or biologically active fragments thereof can encompass all species and strain variations. As used herein, the term "biologically active" fragment of CR1 protein can refer to any soluble fragment of CR1 lacking the transmembrane domain and the cytoplasmic domain, including fragments comprising, consisting essentially of or consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 SCR domains, including any fragments of the full-length CR1 protein having some or all the complement inhibitory activity of the full-length CR1 protein. Functional fragments may include SCRs 1 and 2; SCRs 1,2,3, and 4; SCRs 1, 2, 3, 4, 5, 6, 7; SCRs 1, 2, 3, 4, 5, 6, 7, 8, 9 and 10 ("CR1 1-10"); SCRs 6, 7, 8, 9, 10, 11, and 12; SCRs 8 and 9; SCRs 8, 9, 10, and 11; SCRs 8, 9, 10,11, 12, 13, and 14; SCRs 15 and 16; SCRs 12, 13, 14, 15, 16, and 17; SCRs 15, 16, 17, 18, and 19; SCRs 1 through 17 ("CR1 1-17"); SCRs 1 through 23; SCRs 1 through 28. Example variant polypeptides comprise at least three SCRs of each of domains A and B; at least three SCRs of each of domains A, B and C; at least the first three SCRs of domains A, B, and C, or amino acid sequences at least 90% identical to any of the foregoing.

As used herein, the terms "complement factor H," "factor H," or "FH" can refer to complement factor H, a single polypeptide chain plasma glycoprotein, including homologs thereof. The protein may be composed of 20 conserved short consensus repeat (SCR) domains of approximately 60 amino acids, arranged in a continuous fashion like a string of beads, separated by short linker sequences of 2-6 amino acids each. Factor H may bind to C3b, accelerate the decay of the alternative pathway C3-convertase (C3bBb) as well as the alternative pathway C5 convertase (C3bBb3b), and act as a cofactor for the proteolytic inactivation of C3b. In the presence of factor H, proteolysis by factor I may result in the cleavage and inactivation of C3b. Factor H can have at least three distinct binding domains for C3b, which may be located within any one of SCRs 1-20, SCRs 1-4, SCRs 5-8, and SCRs 19-20. Each domain may bind to a distinct region within the C3b protein: the N-terminal sites may bind to native C3b; the second site, located in the middle region of factor H, may bind to the C3c fragment and the site located within SCR19 and 20 may bind to the C3d region. In addition, factor H can also contain binding sites for heparin, which may be located within SCR 7, SCRs 5-12, and SCR 20 of factor H and may overlap with those of the C3b binding sites. Structural and functional analyses have shown that the domains for the complement inhibitory activity of factor H may be located within the first four N-terminal SCR domains.

SEQ ID No. 9 represents an exemplary amino acid sequence for the full-length human factor H protein (see, e.g., UniProtKB/Swiss-Prot. Accession No. P08603); SEQ ID NO: 10 represents an exemplary amino acid sequence for the full-length mouse factor H protein (see, e.g., UniProtKB/Swiss-Prot. Accession No. P06909). In the human factor H sequence, amino acids 1-18 of SEQ ID NO: 9 may correspond to the signal peptide, and amino acids 19-1231 of SEQ ID NO: 9 may correspond to the mature protein. Within that protein, amino acids 21-80 of SEQ ID NO: 9 may correspond to SCR 1, amino acids 85-141 of SEQ ID NO: 9 may correspond to SCR 2, amino acids 146-205 of SEQ ID NO: 9 may correspond to SCR. 3, amino acids 210-262 of SEQ ID NO: 9 may correspond to SCR 4, and amino acids 267-320 of SEQ ID NO: 9 may correspond to SCR 5. In the mouse factor H sequence, amino acids 1-18 of SEQ ID NO: 10 may correspond to the signal peptide, and amino acids 19-1234 of SEQ ID NO: 10 may correspond to the mature protein. Within that protein, amino acids 19-82 of SEQ ID NO: 10 may correspond to SCR 1, amino acids 83-143 of SEQ ID NO: 10 may correspond to SCR 2, amino acids 144-207 of SEQ ID NO: 10 may correspond to SCR 3, amino acids 208-264 of SEQ ID NO: 10 may correspond to SCR 4, and amino acids 265-322 of SEQ ID NO: 10 may correspond to SCR 5. it is understood that species and strain variations exist for the disclosed peptides, polypeptides, and proteins, and that factor H or biologically active fragments thereof can encompass all species and strain variations. As used herein, the term "biologically active" fragment of factor H can refer to any portion of a factor H protein having some or all the complement inhibitory activity of the full-length factor H protein, and can include, but is not limited to, factor H fragments comprising SCRs 1-4, SCRs 1-5, SCRs 1-8, SCRs 1-18, SCRs 19-20, or any homolog of a naturally-occurring factor H or fragment thereof, as described in detail below. In some examples of the fusion protein constructs, the biologically active fragment of factor H may have one or more of the following properties: (1) binding to C-reactive protein (CRP), (2) binding to C3b and/or its fragments, (3) binding to heparin, (4) binding to sialic acid, (5) binding to endothelial cell surfaces, (6) binding to cellular integrin receptor, (7) binding to pathogens, (8) C3b co-factor activity, (9) C3 and C5 alternative pathway convertase decay-acceleration activity, and (10) inhibiting the alternative complement pathway.

In some examples of the fusion protein constructs, the complement modulator portion of the construct may comprise a complement inhibitor or biologically active fragment thereof. In some examples of the fusion protein constructs, the complement inhibitor may be selected from human MCP, human DAF, mouse DAF, human CD59, mouse CD59 isoform A, mouse CD59 isoform B, mouse Crry protein, human CR1, human factor H, mouse factor H, biologically active fragments thereof, and variants thereof.

In some cases, the complement inhibitor portion of the fusion protein construct may comprise the full-length human MCP (SEQ ID NO: 1). In some cases, the complement inhibitor portion of the fusion protein construct can comprise a biologically active fragment of human MCP (SEQ ID NO: 1). In some cases, the biologically active fragment of human MCP can be selected from SCRs 1-4 (amino acids 35-285 of SEQ ID NO: 1), SCRs 1-4 plus the serine/threonine-rich domain (amino acids 35-326 of SEQ ID NO: 1), and the extracellular domain of MCP (amino acids 35-343 of SEQ ID NO: 1), and any combinations thereof.

In some cases, the complement inhibitor portion of the fusion protein construct can comprise the full-length human DAF. In some cases, the complement inhibitor portion of the fusion protein construct can comprise a biologically active fragment of human DAF (SEQ ID NO: 2). In some cases, the biologically active fragment of human DAF can be selected from SCRs 1-4 (amino acids 25-285 of SEQ ID NO: 2) and SCRs 1-4 plus the O-glycosylated serine/threonine-rich domain (amino acids 25-353 of SEQ ID NO: 2), and any combinations thereof. In some cases, the complement inhibitor portion of the construct can comprise the full-length mouse DAF (SEQ ID NO: 3). In some cases, the complement inhibitor portion of the construct can comprise a biologically active fragment of mouse DAF. In some cases, the biologically active fragment of mouse DAF can be selected from SCRs 1-4 (amino acids 35-286 of SEQ ID NO: 3) and SCRs 1-4 plus the O-glycosylated serine/threonine-rich domain (amino acids 35-362 of SEQ ID NO: 3), and any combinations thereof.

In some cases, the complement inhibitor portion of the fusion protein construct may comprise the full-length human CR1 (SEQ ID NO: 8). In some cases, the complement inhibitor portion of the fusion protein construct can comprise a biologically active fragment of human CR1 (SEQ ID NO: 8). In some cases, the biologically active fragment of human CR1 can be SCR1 (amino acids 42-101 of SEQ ID NO: 8), SCR2 (amino acid 102-163 of SEQ ID NO: 8), SCR3 (amino acids 164-234 of SEQ ID NO: 8), SCR4 (amino acids 236-295 of SEQ ID NO: 8), SCR5 (amino acids 295-355 may of SEQ ID NO: 8), SCR6 (amino acids 356-418 of SEQ ID NO: 8), SCR7 (amino acids 419-489 of SEQ ID NO: 8), SCR8 (amino acids 491-551 of SEQ ID NO: 8), SCR9 (amino acids 552-613 of SEQ ID NO: 8), SCR10 (amino acids 614-684 of SEQ ID NO: 8), SCR11 (amino acids 686-745 of SEQ ID NO: 8), SCR12 (amino acids 745-805 of SEQ ID NO: 8), SCR13 (amino acids 806-868 of SEQ ID NO: 8), SCR14 (amino acids 869-939 of SEQ ID NO: 8), SCR15 (amino acids 941-1001 of SEQ ID NO: 8), SCR16 (amino acids 1002-1063 of SEQ ID NO: 8), SCR17 (amino acids 1064-1134 of SEQ ID NO: 8), SCR18 (amino acids 1136-1195 of SEQ ID NO: 8), SCR19 (amino acids 1195-1255 of SEQ ID NO: 8), SCR20 (amino acids 1256-1318 of SEQ ID NO: 8), SCR21 (amino acids 1319-1389 of SEQ ID NO: 8), SCR22 (amino acids 1394-1454 of SEQ ID NO: 8), SCR23 (amino acids 1455-1516 of SEQ ID NO: 8), SCR24 (amino acids 1517-1587 of SEQ ID NO: 8), SCR25 (amino acids 1589-1648 of SEQ ID NO: 8), SCR26 (amino acids 1648-1708 of SEQ ID NO: 8), SCR 27 (amino acids 1709-1771 of SEQ ID NO: 8), SCR28 (amino acids 1772-1842 of SEQ ID NO: 8), SCR29 (amino acids 1846-1906 of SEQ ID NO: 8), SCR30 (amino acids 1907-1967 of SEQ ID NO: 8), or any combinations thereof.

In some cases, the complement inhibitor portion of the fusion protein construct may comprise the full-length human factor H (SEQ ID NO: 9). In some cases, the complement inhibitor portion of the fusion protein construct can comprise a biologically active fragment of human factor H (SEQ ID NO: 9). In some cases, the complement inhibitor portion of the fusion protein construct may comprise the full-length mouse factor H (SEQ ID NO: 10). In some cases, the complement inhibitor portion of the fusion protein construct can comprise a biologically active fragment of mouse factor H (SEQ ID NO: 10). The biologically active fragment of factor H can comprise SCRs 1-4, SCRs 1-5, SCRs 1-8, SCRs 1-18, SCRs 19-20 of factor H, or any homolog of a naturally-occurring factor H or fragment thereof, or any combinations thereof.

Targeting Moiety

The targeting moiety of the multivalent construct can be responsible for targeted delivery of the modulator of the complement system to the sites of action, such as the site of complement activation. The complement modulator can have a therapeutic activity such as specifically inhibiting complement activation. The multivalent construct described herein thus generally has the dual functions of binding to an epitope recognized by an antibody described herein and exerting therapeutic activity through inhibition of complement activation. The targeting moiety can be an antibody or an antigen binding fragment thereof that is human, murine, humanized, or camelized.

The epitope recognized by the antibody or antigen binding fragment thereof can be a domain of a mammalian annexin protein, a phospholipid, such as one or more of the C2 antibody-reactive phospholipids described below, or a complement protein, such as C3d, C3 fragments (e.g, deposited C3 fragments—C3b, iC3b, C3d, C3dg; free or undeposited C3 fragments—C3a, C3b, C3c or C3f).

The antibody or antigen-binding fragment thereof can specifically bind to a domain of a mammalian annexin protein. The annexins are a family of calcium—($Ca^{2+}$) and phospholipid-binding proteins that differ from most other $Ca^{2+}$ binding proteins in their $Ca^{2+}$ binding sites. The annexin family $Ca^{2+}$ binding site has a unique architecture that enables annexin family members to reversibly dock onto the periphery of cellular and/or organellar membranes. The conserved. $Ca^{2+}$ binding site characteristic of annexin family members is located in the annexin core domain, and comprises four annexin repeats, each seventy (70) amino acids long. The annexin core domain is a-helical and forms a compact, curved disc with a convex surface comprising the $Ca^{2+}$ and membrane-binding sites and a concave side oriented away from the membrane that is available for other types of interaction. Annexin family members also typically have an amino-terminal domain of variable length that precedes the annexin core domain and is diverse in sequence and structure. Twelve annexin subfamilies have been characterized in vertebrates, including annexin. IV and annexin 2, each having different splice variants, with different amino-terminal domains and differently positioned $Ca^{2+}$ binding sites. The antibody or antigen-binding fragment thereof, that specifically binds to a domain within or recognizes an epitope within the annexin IV protein, can be a B4 mAb or an antigen binding fragment derived from the B4 mAb. The antibody or antigen-binding fragment thereof, that specifically binds to a domain within or recognizes an epitope within the annexin IV protein (e.g., human annexin IV protein), can be a B4 mAb or an antigen binding fragment derived from the B4 mAb, described in Kulik et al., J Immunol. 182(9): 5363 (2009). Exemplary CDRs of B4 mAb are provided in SEQ ID NOS: 11-16. The targeting moiety can further be an antibody or an antigen binding fragment thereof that specifically binds to or recognizes an epitope within the annexin 2 protein (e.g., human annexin 2 protein).

The antibody or antigen-binding fragment thereof can also specifically bind to a phospholipid (e.g., phosphatidylethanolamine (PE), cardiolipin (CL), phosphatidylcholine (PC), phosphatidylinositol, phosphatidylglycerol, phosphatidylserine, or phosphatidic acid) or malondialdehyde (MDA). The antibody or antigen-binding fragment thereof, that specifically binds to a phospholipid, can be a C2 mAb or derivative thereof. The phospholipid can be present on the surface of a cell, a basement membrane (e.g., Bruch's membrane), or in a pathological structure (e.g., drusen) in an individual that is in or adjacent to a tissue undergoing (or at risk of undergoing) tissue injury (such as nonischemic injury), oxidative damage, or any combinations thereof. The phospholipid can be neutral, negatively or positively charged, or oxidized. The antibody or antigen-binding fragment thereof, that specifically binds to a phospholipid, can be a C2 mAb, or an antigen binding fragment derived from the C2 mAb, described in Elvington et al., J Immunol., 188(3): 1460-1468 (2012). Exemplary CDRs of C2 mAb are provided in SEQ ID NOS: 17-22. C2 mAb recognizes a subset of phospholipids that are exposed after complement activation or ischemia; this subset of phospholipids is referred to herein as "C2 antibody-reactive phospholipids." C2 mAb has been shown to recognize a subset of phospholipids that included phosphatidylcholine, phosphatidylethanolamine and cardiolipin, but not phosphatidylglycerol or phosphatidylserine.

The targeting moiety, in some cases, can be an antibody or an antigen-binding fragment thereof, which specifically binds to deposited or opsonized C3 fragments, e.g., C3b, iC3b, C3d or C3dg, but may or may not bind to free or circulating or undeposited C3 fragments, e.g., C3a, C3b, C3c or C3f. In some examples, it is possible for fusion protein constructs comprising an anti-C3d or anti-C3dg antibody or an antigen-binding fragment thereof to bind with relatively higher affinity to deposited C3 fragments compared to free C3 or C3 fragments. For example, the antibody or antigen-binding fragment thereof can bind C3 and C3b with about 5-fold, about 6-fold, about 7-fold, about 8-fold, about 9-fold, or about 10-fold lower binding affinity compared to C3d. In some embodiments, the antibody or antigen-binding fragment binds C3 and/or C3b with a KD of $10^{-4}$M or higher, $10^{-3}$M, or higher, or $10^{-2}$M or higher, and binds iC3b, C3dg, or both, with a binding affinity (KD) of $10^{-8}$ M or less, $10^{-9}$M or less, or $10^{-10}$ M or less.

In some examples, it is possible for fusion protein constructs comprising an anti-C3d or anti-C3dg antibody or an antigen-binding fragment thereof to bind to deposited C3 fragments as well as free C3 or C3 fragments. It is further possible that the anti-C3d or anti-C3dg antibody or an antigen-binding fragment thereof, of an exemplary fusion protein construct, can bind to complement fragment C3d and have the ability to discriminate between tissue bound C3 fragments from circulating C3 (e.g., C3, C3b, or $C3(H_2O)$. Examples of the anti-C3d or anti-C3dg antibodies or antigen binding fragments thereof include, but are not limited to, mAbs 3d9a, 3d29 and 3d8b (See, e.g., U.S. Pat. No. 9,815, 890). In some instances, the anti-C3d or anti-C3dg antibodies of this disclosure can bind to C3d with greater specificity than commercially available anti-C3d antibodies, such as, for example, anti-C3d antibodies designated by the Quidel catalog numbers A207 and A250, that are commercially available from the Quidel Corporation (Quidel Corp., San Diego and Santa Clara, Calif.). In some cases, the targeting moiety can comprise an antibody specific to C3d and/or other C3 fragments (C3b, iC3b, C3c, C3dg, etc.), such as an antibody C8D3 as described in US Patent Application Publication No. 2016/0333082. The antibody C8D3 can bind to an epitope on C3d with high affinity (see, e.g., FIGS. 3 and 8 of US 2016/0333082), which overlaps with the CR2 binding epitope. The C8D3 heavy chain sequence can be SEQ ID NO: 154, and light chain sequence is SEQ ID NO: 155; the C8D3 CDRH1, CRDH2 and CDRH3 are SEQ ID NO: 156, 157 and 158, respectively, and CDRL1, CDRL2 and CDRL3 are SEQ ID NO: 159, 160 and 161, respectively. Also described in this publication are four hybridoma clones which produce antibodies to C3d (i.e., Clones B7, C2, C6 and C8). The C6 heavy chain sequence is SEQ ID NO: 162, and light chain sequence is SEQ ID NO: 163; the C6 CDRH1, CDRH2 and CDRH3 are SEQ ID NO: 164, 165 and 166, respectively, and. CDRL1, CDRL2 and CDRL3 are SEQ ID NO: 167, 168 and 169, respectively.

In some examples, the C3d antibody can be an antibody which binds C3d, but not C3c ("Neo-Anti-C3d"), as described in US Patent Application Publication No. 2015/0139899. The binding between the C3d antibody and its epitope with an affinity of about 100 pM to about 500 pM, e.g., 447 pM. The C3d antibody can also be an antibody specific for the neoepitope iC3b ("Neo Anti-iC3b"), and, in some cases, bind its epitope with an affinity of about 100 pM to about 500 pM e.g., 262 pM, however, said antibody does not bind C3c or C3d.

In some examples, the C3d antibody can be monoclonal antibody M130 which is specific for an antigenic determinant expressed by C3bi, C3dg, and C3d, which is almost undetectable in C3 and C3b. M130 has been shown to have higher affinity to C3d and iC3b than C3(H20) (J. D. Tamerius et al., J. Immunol. 135(3): 2015-19 (1985)) and can bind to C3d at residues 1209-1236, and 1217-1232 (Lambris et al., PNAS, 82(12): 4235-9 (1985).

In some examples, the C3d antibody can be monoclonal antibody C3-12.2 which binds to human, rat and mouse C3dg fragments (Hidalgo et al., Eur. J. Immunol. 47(3): 504-15 (2017)). It was prepared using C3 deficient mice immunized with human C3b, iC3b and C3dg protein mixture, and has $K_D$ of about 95 nM measured by BiaCore. C3-12.2 and antibodies 3d29, 3d8b and 3d9a can recognize one or more overlapping C3 fragments or variants and the Fab appears to bind to the same or neighboring epitope as CR2.

In some examples, the C3d antibody can be monoclonal antibody 15-39-06 which was raised in wild-type rats using a synthetic peptide derived from human C3dg and conjugated to diphtheria toxin (K. J. Rassmussen et al., J. immunol. Methods, 444: 51-5 (2017)). It may have specificity to C3dg complement split product.

In some examples, the C3d antibody can be commercially available antibodies specific to C3d and/or other C3 fragments (i.e., C3b, iC3b, C3c, C3dg, etc.). Examples include antibodies available from Quidel, monoclonal antibodies A250 and A209 are reported to be specific for the neoepitopes C3d and iC3b, respectively. Antibody A250 was shown to agglutinate EC3bi, EC3b and EC3d cells in an indirect hemagglutination assay, and was also shown to bind to radio-labeled purified iC3b, C3b, and C3d but not to similarly labeled C3, or C3c. Antibody A209 was shown to agglutinate EC3bi but not EC3b or EC3d cells in an indirect hemagglutination assay, and was also shown to bind to radio-labeled purified iC3b but not to similarly labeled C3, C3b, C3d, or C3c. Further examples include available from Abcam are anti-C3d antibody 7C10 with unknown epitopes and anti-C3d antibody [E28-P] (ab136916) which is reported to bind an epitope at the N-terminus of C3d. In some cases, commercial antibodies can be antibodies available from BioRad are anti-C3d antibody 053A-514.3.1.4 and iC3b antibody 013III-1.16 (f.k.a. MCA2607) are reported to be specific to neoantigens C3d and iC3b, respectively. Available from Sigma is antibody 3E7 is reported to recognize C3b and iC3b. Available from Origene, monoclonal antibody AM26358PU-N reacts with a neoantigen on iC3 (C3(H2O)), iC3b, C3dg and/or C3g and recognizes iC3b, C3dg and C3g in plasma but does not recognize C3 or C3b. Available from U.S. Biological Life Sciences is antibody C0010-19 rat anti-C3g (recognizing iC3, iC3b, C3dg). Also available from U.S. Biological Life Sciences, C7850-13V-ML550 mouse anti-complement C3b, inactivated. This antibody is reported to recognize human inactivated complement C3b (iC3b) neoantigen in blood serum. Available from Hycult are a number of antibodies including antibody HM2199, anti-human C3g mAb 9 (YB2/90-5-20, which reacts with a neoantigen on iC3, iC3b, C3dg and C3g, and which recognizes iC3b, C3dg and C3g in plasma but does not recognize C3 or C3b; monoclonal antibody HM2198—anti-human C3d, mAb 3 (YB2/39-11-1-7) which is reported to react with a linear determinant in C3d found on C3, C3b, iC3b, C3dg and C3d and which recognizes C3, C3b, iC3b, C3dg and C3d, but not C3c; antibody HM2168—anti-activated human C3, clone bH6 which is specific for a C3 neoepitope expressed on the cleavage fragments of C3b, iC3b and C3c, but not C3dg and C3f (P. Garred et al., Scand J Immunol 1988, 27: 319); and antibody HM2257—activated human C3, mAb 13/15 which recognizes activated complement protein C3 or more specifically a neoepitope on C3b, iC3b and C3dg which are not present in native C3.

Available from Meridian, antibody H54189M is reported to react with the alpha chain of C3b, but not with C3a or C3d, and allows demonstration of C3 deposits in tissue, on cells, on microorganisms and in immune complexes.

Each of the 3d9a, 3d29 and 3d8b antibodies may be able to bind to kidney tissue sections exhibiting inflammation when injected into mice intravenously, and bind to C3-opsonized zymosan, which is known to express iC3b but not C3b. Thus, these antibodies may be able to distinguish between tissue bound fragment C3d and circulating native C3 and the fragment C3b. The C3 binding antibody or antigen-binding fragment thereof, can bind to C3d or C3dg from multiple species (species cross-reactive). The anti-C3d or anti-C3dg antibody or antigen-binding fragment thereof can bind to C3d or C3dg from at least one species selected from human, non-human mammals (e.g., cynomolgus monkey or cynomolgus macaque, rhesus macaque, ape, baboon, chimpanzee, orangutan, or gorilla), rodents (e.g., mouse, rat, hamster, Guinea pig, gerbil, or rabbit), cattle, sheep, goat, donkey, pig, dog, cat, horse, and camel. The anti-C3d or anti-C3dg antibody or antigen-binding fragment thereof can bind to cynomolgus macaque C3d or C3dg. The anti-C3d or anti-C3dg antibody or antigen-binding fragment thereof described herein binds to C3d or C3dg from at least two species selected from the above list. The anti-C3d or anti-C3dg antibody or antigen-binding fragment thereof binds to both human and cynomolgus macaque C3d or C3dg. The anti-C3d or anti-C3dg antibody or an antigen-binding fragment thereof can be an antibody selected from: 3d8b, 3d9a, 3d29, 3d11, 3d31, 3d3, 3d15, 3d10, and 3d16 (See e.g., U.S. Pat. No. 9,815,890). The anti-C3d or anti-C3dg antibody or an antigen-binding fragment thereof can be an antibody selected from: 3d9a, 3d29 and 3d8b. The anti-C3d or anti-C3dg antibody or an antigen-binding fragment thereof can be 3d29.

In some examples, the anti-C3d or anti-C3dg antibody, or antigen-binding fragment thereof, of the fusion protein constructs, can compete with CR2 for binding to C3d or C3dg. Such an antibody or antigen-binding fragment thereof can reduce the ability of a CR2 protein to bind to human complement component C3d or C3dg by greater than 50 (e.g., greater than 55, 60, 65, 70, 75, 80, 85, 90, or 95 or more) %. For example, the CR2-C3d binding can be decreased to at least 60%, at least 40%, or to a % value in between. The anti-C3d or anti-C3dg antibody, or antigen-binding fragment thereof, can significantly inhibit or block CR2 binding to C3d. In some embodiments, such an antibody is 3d9a, 3d29 or 3d8b. Exemplary fusion protein constructs comprising anti-C3d or anti-C3dg targeting domains and a complement modulator, in some cases, can better compete with CR2 binding to C3d or C3dg, than an anti-C3d or anti-C3dg targeting domain alone.

Fusion Protein Construct Designs

The fusion protein constructs, comprising a targeting moiety and the complement modulator, can include an antibody or an antigen-binding fragment thereof as the targeting moiety. Examples of the targeting moiety include, but are not limited to, a monoclonal antibody or antibody fragment, a diabody, a chimerized or chimeric antibody or antibody fragment, a humanized antibody or antibody fragment, a deimmunized human antibody or antibody fragment, a fully human antibody or antibody fragment, a bispecific antibody or antibody fragment, a monovalent antibody or antibody fragment, a single chain antibody, an immunoglobulin G1 (IgG1) heavy chain, a single chain variable fragment (i.e., an scFv), sc(fv)2, a tandem scFv, a diabody, a VHH domain, a VH domain, an Fv, an Fd, an Fab heavy chain, an Fab light chain, an Fab, an Fab', and Fab' light chain, an Fab' heavy chain, and an F(ab')2. The antibody or antigen binding fragments that form the targeting moiety, can be a human antibody, a humanized antibody, a murine antibody. The fusion protein constructs can include one or more targeting moieties, such that each targeting moiety comprising an antibody or an antigen binding fragment thereof specific for a target. In addition, it is possible that the fusion protein constructs include more than one complement modulator. When the fusion protein construct includes more than one complement modulators, it may comprise multiple molecules of the same complement modulator or it may comprise distinct types of complement modulators. Similarly, fusion protein constructs that have multiple targeting moieties, may comprise several molecules of the same type of targeting moiety, thereby being multivalent with respect to the targeting moiety, or distinct types of targeting moieties, thereby being multispecific with respect to the targeting moiety. Targets of the fusion protein constructs can be, for example, a complement protein or a fragment thereof, a domain of a mammalian annexin protein, or a phospholipid. Since the fusion protein constructs may have the ability to specifically bind to more than one target, it is contemplated that, in some examples, at least two of the above mentioned targets can be specifically bound by the fusion protein constructs described here. Accordingly, the fusion protein construct can be a bispecific, trispecific, tetraspecific etc. Furthermore, it is possible for the fusion protein constructs to be multivalent, such as bivalent, trivalent, tetravalent etc. For instance, the targeting moiety of a fusion protein construct which is bispecific can be specific for a target such as a domain of mammalian annexin, a phospholipid, or a C3 complement protein fragment (e.g., C3d), and the complement modulator of the fusion protein construct can be specific for another protein in the complement pathway. A tetravalent fusion protein construct can have a targeting moiety that is bivalent, such as a bivalent antibody or antigen binding fragment thereof that has two binding regions for a target protein, and two molecules of a complement modulator. It is further possible for the fusion protein construct to be a bispecific trivalent protein where the targeting moiety includes a bivalent antibody or antigen binding fragment thereof and a constant domain (Fc) of an antibody, and the complement modulator is fused to the bivalent antibody or to the Fc domain.

Other examples of the fusion protein construct include an Fc region which is heterodimeric, comprising various modifications that promote formation of a heterodimeric Fc region over a homodimeric Fc region. See e.g., J H Ha et al. Immunoglobulin. Fc Heterodimer Platform Technology: From Design to Applications in Therapeutic Antibodies and Proteins. Front. Immuno. 7:394 (2016). Conventional IgG antibodies are multivalent and monospecific, the assembly of which depends upon in vivo homodimerization of two identical heavy chains (HCs), which is mediated by homodimeric associations between CH3 domains, and subsequently disulfide linkages between each HC and each light chain (LC), in B cells. Thus, the development of bsAbs, using intact IgG formats with wild-type HCs and LCs, may involve HC-HC and HC$_{VH-CH1}$-LC mispairing problems. In addition, the development of trivalent fusion constructs that have a complement modulator linked to only one of two HCs, or only one of two LCs may involve mispairing problems. Accordingly, the heterodimeric Fc region of the targeting moieties disclosed herein may be advantageous in terms of avoiding HC mispairing problem. Although the wild-type Fc region is a homodimer of polypeptides, the Fc domains disclosed herein, in some examples, comprise amino acid substitutions such that they do not form homodimers. The monomeric Fc domains, Fc1 and Fc2, are in some embodiments IgG Fc. In some embodiments, the monomeric Fc domains, Fc1 and Fc2, are from other immunoglobulin subclasses including IgA, IgE, IgD, and IgM. The heterodimer Fc regions of the targeting moieties described herein comprise a variant CH3 constant domain comprising amino acid mutations that promote the formation of said heterodimer with stability comparable to a native homodimeric Fc, and a CH2 constant domain. The wild-type Fc is homodimeric in nature and this feature is driven by both hydrophobic interactions at the center of the CH3 interface and symmetric electrostatic interactions around the rim of the hydrophobic core. The Fc domains described herein can comprise amino acid substitutions such that they do not form homodimers. The Fc domains described herein can comprise amino acid substitutions that favor formation of heterodimers over homodimers. In certain examples, the heterodimeric Fc domain is created using (i) symmetric-to-asymmetric steric complementarity design (e.g., KiH, HA-TF, and ZW1) (see e.g., Klein et al. Progress in overcoming the chain association issue in bispecific heterodimeric IgG antibodies. mAbs 4(6): 653-66 (2012); G. L. Moore et al. A novel bispecific antibody format enables simultaneous bivalent and monovalent co-engagement of distinct target antigens. mAbs 3(6) 546-557 (2011); T. S. von Kreudenstein et al. Improving biophysical properties of a bispecific antibody scaffold to aid developability: Quality by molecular design. mAbs 5(5): 646-654 (2013); H. J. Choi et al. A heterodimeric Fc-based bispecific antibody simultaneously targeting VEGFR-2 and Met exhibits potent antitumor activity. Mol Cancer Ther 12(12):2748-59 (2013), (ii) charge-to-charge swap (e.g., DD-KK), (iii) charge-to-steric complementarity swap plus additional long-range electrostatic interactions (e.g., EW-RVT), and (iv) isotype strand swap [e.g., strand-exchange engineered domain (SEED)]. Strand exchange mutations include, for example, IgA-derived 45 residues on IgG1 CH3-Fc1 and IgG1-derived 57 residues on IgA CH3-Fc2, or vice versa. Examples of symmetric-to-asymmetric sterically complementary mutations include HA-TF (S364H/F405A in Fc1-CH3 or CH3A and Y349T/T394F in Fc2-CH3 or CH3B), ZW1 (T350V/L351Y/F405A/Y407V in Fc1-CH3 or CH3A and T350V/T366L/K392L/T394W in Fc2-CH3 or CH3B). In other examples, the Fc variant can be generated using the "Knobs-into-holes (KiH)" approach where Fc 1 comprises a T366W "knob" mutation, in Fc1-CH3 or CH3A, and Fc2 comprises T366S/L368A/Y407V "hole" mutations in Fc2-CH3 or CH3B domain. In additional examples, the Fc variant can be generated using the "Knobs-into-holes (KiH)" plus disulfide bond approach, where Fc1 comprises a T366W/S354C "knob" mutation, in Fc1-CH3 or CH3A, and Fc2 comprises T366S/L368A/Y407V/Y349C "hole" mutations in Fc2-CH3 or CH3B domain. In such examples, the heterodimerization is favored through hydrophobic interactions at the core of the Fc1-CH3 or CH3A and Fc2-CH3 or CH3B interface. Examples of charge-charge swap mutations, where the Fc heterodimer favoring interaction is based on electrostatic complementarity include DD-KK (K409D/K392D in Fc1-CH3 or CH3A and D399K/E356K in Fc2-CH3 or CH3B, or vice versa). Examples of charge-to-steric complementarity swap plus additional long-range electrostatic interaction mutations include EW-RVT (K360E/K409W in Fc1-CH3 or CH3A and Q347R/D399V/F405T in Fc2-CH3 or CH3B, or vice versa); EW-RVTs-s (K360E/K409W/Y349C in Fc1-CH3 or CH3A and Q347R/D399V/F405T/S354C in Fc2-CH3 or CH3B, or vice versa), which comprises an inter-CH3 S—S bond. In yet other examples, the Fc variant can be generated using hydrophobic or steric complementarity plus electrostatic complementarity, such as 7.8.60 (K360D/D399M/Y407A in Fc1-CH3 or CH3A and E345R/Q347R/T366V/K409V in Fc2-CH3 or CH3B, or vice versa). The heterodimer forming Fc variants described herein can also be generated through directed evolution combined with yeast surface display and high-throughput screening. For example, a combinatorial heterodimeric Fc library display system can be developed by mating two haploid yeast cell lines; one haploid cell line displaying an Fc chain library (CH3-Fc1 or CH3A) with mutations in one CH3 domain on the yeast cell surface, and the other cell line secreting an Fc chain library (CH3-Fc1 or CH3B) with mutations in the other CH3 domain. In the mated cells, secreted CH3-Fc2 or CH3B can be displayed on the cell surface through heterodimerization with the displayed CH3-Fc1 or CH3A. Fluorescence-based detection of this interaction enables screening of the library for heterodimeric Fc variants by flow cytometry. An antibody or an antigen binding fragment thereof, that includes a wild-type Fc domain has the ability to interact with neonatal Fc-receptor (FcRn) in a pH dependent manner; this interaction can confer extended serum half-life. The residues important for the high-affinity interaction of Fc domain and FcγR are located within the CH2 domain. Accordingly, in some instances, the Fc heterodimer of the targeting moieties comprise CH2 domains which have wild type IgG sequence.

In some examples, the "CH3 domain," comprising the stretch of residues C-terminal to a CH2 domain in an Fc region (i.e. from an amino acid residue at about position 341 to an amino acid residue at about position 447 of an IgG), may be a native sequence CH3 domain or a variant CH3 domain (e.g. a CH3 domain with an introduced "protuberance" in one chain thereof and a corresponding introduced "cavity" in the other chain thereof). Such variant CH3 domains may, in some examples, be part of a heterodimeric Fc domain as described here. Accordingly, in some examples, the fusion protein construct comprises a protuberance-into-cavity antibody or an antigen-binding fragment thereof.

In some examples, the Fc region can comprise a human or murine IgG1 or human IgG4 sequence. In some examples, the Fc region can comprise a human IgG1 or IgG4, or murine IgG1 sequence comprising amino acid substitutions relative to the wild-type sequence. Examples of such Fc regions are provided in SEQ ID Nos. 247 and 248.

Domains and Structures of Fusion Proteins Constructs

The fusion protein construct comprises one or more polypeptides, each containing domains, and connected, for example, via one or more disulfide bonds. For instance, in some cases, the fusion protein construct can comprise a first polypeptide chain which comprises domain A, domain B, domain C, domain D, and domain R, wherein domain A comprises a heavy chain variable region amino acid sequence (VH), or an antigen-binding fragment thereof, domain B comprises a heavy chain CH1 constant region amino acid sequence, domain C comprises a heavy chain CH2 constant region amino acid sequence, domain D comprises a heavy chain CH3 constant region amino acid sequence, and domain R comprises a complement modulator polypeptide. In some embodiments, one or more of domains B, C and D are optional. The first polypeptide can further comprise a hinge region and the first polypeptide can further be connected to a second polypeptide which comprises further domains, such as domain E which comprises a light chain variable region amino acid sequence (VL), or an antigen-binding fragment thereof, and optionally domain F which comprises a light chain constant region amino acid sequence (CL1). The connection between the first and the second polypeptide can be by one or more disulfide bonds between domains B and F. In some examples, the first and the second polypeptides, as described above, are combined using various orientations to generate fusion protein constructs that are monomeric, trivalent homodimeric, trivalent homodimeric, tetravalent homodimeric, tetravalent heterodimeric, etc.

In various examples of multivalent fusion protein constructs (e.g., bivalent, trivalent, tetravalent), multivalency of the fusion protein construct can improve the avidity of the fusion protein construct for a specific target. As described herein, "avidity" can refer to the overall strength of interaction between two or more molecules, e.g., a fusion protein construct that comprises a bivalent targeting moiety, the avidity can be the cumulative strength of interaction provided by the affinities of two antigen binding sites. Avidity can be measured, for example, by the same methods as those used to determine affinity. In certain examples, the avidity can be the cumulative strength of interactions provided by the affinities of multiple antigen binding sites for separate antigens on a shared specific target or complex, such as separate antigens found on an individual cell. In certain examples, the avidity can be the cumulative strength of interaction provided by the affinities of multiple antigen binding sites for separate epitopes on a shared individual antigen.

Domain A (VH)

Domain A of the fusion protein constructs described here can comprise a VH amino acid sequence, such as antibody heavy chain variable domain sequences. In a typical antibody arrangement in both nature and in the fusion protein constructs described herein, a specific VH amino acid sequence can associate with a specific VL amino acid sequence to form an antigen-binding site. In various examples, VH amino acid sequences are mammalian sequences, including human sequences, and synthesized sequences, or combinations of non-human mammalian, mammalian, and synthesized sequences. In various examples, VH amino acid sequences can be mutated sequences of naturally occurring sequences that retain sufficient CDR sequence to retain the desired antigen-binding affinity. In some examples, the VH sequences can be from an IgA1, IgA2, IgD, IgE, IgG1, IgG2, IgG3, IgG4, or IgM isotype. In some examples, the VH sequences can be from an IgG1 isotype.

Domain E (VL)

Domain E of the fusion protein constructs described herein, can comprise a VL amino acid sequence, such as antibody light chain variable domain sequences. In a typical arrangement in both natural antibodies and the fusion protein constructs described herein, a specific VL amino acid sequence can associates with a specific VH amino acid sequence to form an antigen-binding site. In various examples, the VL amino acid sequences can be mammalian sequences, including human sequences, synthesized sequences, or combinations of human, non-human mammalian, mammalian, and synthesized sequences. In various examples, VL amino acid sequences can be mutated sequences of naturally occurring sequences that retain at least 70%, 75%, 80%, 85%, 90%, 95% or more amino acid identity. In certain examples, the VL amino acid sequences can be lambda (λ) light chain variable domain sequences. In certain examples, the VL amino acid sequences can be kappa (κ) light chain variable domain sequences. In some examples, the VL sequences can be from an IgA1, IgA2, IgD, IgE, IgG1, IgG2, IgG3, IgG4, or 1gM isotype. In some examples, the VL sequences can be from an IgG1 isotype
Domain B (CH1)

The CH1 amino acid sequences of the fusion protein constructs described herein can be sequences of the second domain of an antibody heavy chain, with reference from the N-terminus to C-terminus. In certain examples, the CH1 sequences can be endogenous sequences or mutated sequences thereof that retain at least 70%, 75%, 80%, 85%, 90%, 95% or more amino acid identity. In some examples, the CH1 sequences can be mammalian sequences, including, but not limited to mouse, rat, hamster, rabbit, camel, donkey, goat, and human sequences. In some examples, the CH1 sequences can be human sequences. In some examples, the CH1 sequences can be from an IgA1, IgA2, IgD, IgE, IgG1, IgG2, IgG3, IgG4, or IgM isotype. In some examples, the CH1 sequences can be from an IgGi isotype. In some examples, the CH1 sequences can be from an IgG4 isotype.
Domain F (CL1)

The CL amino acid sequences of the fusion protein constructs described herein can be antibody light chain constant domain sequences. In certain examples, the CL sequences can be endogenous sequences or mutated sequences thereof that retain at least 70%, 75%, 80%, 85%, 90%, 95% or more amino acid identity. In some examples, the CL sequences can be mammalian sequences, including, but not limited to mouse, rat, hamster, rabbit, camel, donkey, goat, and human sequences. In some examples, CL sequences can be human sequences. In certain examples, the CL amino acid sequences can be lambda (λ) light chain constant domain sequences. In some examples, the CL amino acid sequences can be human lambda light chain constant domain sequences. In certain embodiments, the CL amino acid sequences are kappa (K) light chain constant domain sequences. In a preferred embodiment, the CL amino acid sequences are human kappa (κ) light chain constant domain sequences.
Domain C (CH2)

In the fusion protein constructs described herein, domain C can have a CH2 amino acid sequence. CH2 sequences can be endogenous sequences or mutated sequences thereof that retain at least 70%, 75%, 80%, 85%, 90%, 95% or more amino acid identity. In some examples, the CH2 sequences can be mammalian sequences, including, but not limited to human sequences. In some examples, the CH2 amino acid sequence can have an N-terminal hinge region that connects domain C to domain B, e.g., connecting the C-terminus of domain B (CL1 sequence), to the N-terminus of domain C (CH2 sequence). In some examples, the CH2 sequences can be from an IgA1, IgA2, IgD, IgE, IgG1, IgG2, IgG3, IgG4, or IgM isotype. In some examples, the CH2 sequences can be from an IgG1 isotype. In some examples, the CH2 sequences can be from an IgG4 isotype.
Domain D (CH3)

In the fusion protein constructs described herein, domain D can comprise a constant region domain amino acid sequence, such as a CH3 amino acid sequence. CH3 sequences can be endogenous sequences or mutated sequences thereof that retain at least 70%, 75%, 80%, 85%, 90%, 95% or more amino acid identity. In some examples, the CH3 sequences can be mammalian sequences, including, but not limited to human sequences. In some examples, domain D can comprise a constant region sequence that is a CH3 sequence comprising knob-hole orthogonal mutations; isoallotype mutations; and either a S354C or a Y349C mutation that forms an engineered disulfide bridge with a CH3 domain containing an orthogonal mutation, or any combinations thereof. In some examples, the knob-hole orthogonal mutations combined with isoallotype mutations can comprise the following mutational changes: D356E, L358M, T366S, L368A, and Y407V. In some examples, the CH3 sequences can be from an IgA1, IgA2, IgD, IgE, IgG1, IgG2, IgG3, IgG4, or IgM isotype. In some examples, the CH3 sequences can be from an IgG1 isotype. In some examples, the CH3 sequences can be from an IgG4 isotype. In any of these examples, the CH1, CH2 and CH3 sequences can be from the same isotype, e.g. IgG1 or IgG3.
Complementarity Determining Regions within Domain A and Domain F The VH (domain A) and VL (domain F) amino acid sequences of the various fusion protein constructs described herein can comprise highly variable sequences termed "complementarity determining regions" (CDRs), typically three CDRs (CDR1, CD2, and CDR3). In a variety of examples, the CDRs can be mammalian sequences, including, but not limited to, mouse, rat, hamster, rabbit, camel, donkey, goat, and human sequences. In some examples, the CDRs can be human sequences. In some examples, the CDRs can be naturally occurring sequences. In some examples, the CDRs can be naturally occurring sequences that have been mutated to alter the binding affinity of the antigen-binding site for a particular antigen or epitope. In certain examples, the naturally occurring CDRs may have been mutated in an in vivo host through affinity maturation and somatic hypermutation. In certain examples, the CDRs may have been mutated in vitro through methods including, but not limited to, PCR-mutagenesis and chemical mutagenesis. In various examples, the CDRs can comprise synthesized sequences including, but not limited to, CDRs obtained from random sequence CDR libraries and rationally designed CDR libraries.
Framework Regions and CDR Grafting The VII and VL amino acid sequences can further comprise "framework region" (FR) sequences. FRs generally can be conserved sequence regions that can act as a scaffold for interspersed CDRs, typically in a FR1-CDR1-FR2-CDR2-FR3-CDR3-FR4 arrangement (from. N-terminus to C-terminus). In a variety of examples, the FRs can be mammalian sequences, including, but not limited to mouse, rat, hamster, rabbit, camel, donkey, goat, and human sequences. In some examples, the FRs can be human sequences. In various examples, the FRs can be naturally occurring sequences. In various examples, the FRs can be synthesized sequences including, but not limited, rationally designed sequences.

In a variety of examples, the FRs and the CDRs can both be from the same naturally occurring variable domain sequence. In a variety of embodiments, the FRs and the CDRs can be from different variable domain sequences, wherein the CDRs can be grafted onto the FR scaffold with the CDRs providing specificity for a particular antigen. In certain examples, the grafted CDRs can all be derived from the same naturally occurring variable domain sequence. In certain examples, the grafted CDRs can be derived from different variable domain sequences. In certain examples, the grafted CDRs can be synthesized sequences including, but not limited to, CDRs obtained from random sequence CDR libraries and rationally designed CDR libraries. In certain examples, the grafted CDRs and the FRs can be from the same species. In certain example, the grafted CDRs and the FRs can be from different species. In certain examples, the various domains of the fusion protein constructs can be "humanized", wherein the grafted CDRs are non-human mammalian sequences including, but not limited to, mouse, rat, hamster, rabbit, camel, donkey, and goat sequences, and the FRs are human sequences. In various examples, portions or specific sequences of FRs from one species can be used to replace portions or specific sequences of another species' FRs.

Homodimeric or Heterodimeric Pairing of Two Domain Ds (CH3 Domains)

In the fusion protein constructs described herein, two domain Ds can be associated to form a dimeric construct. In various examples, the amino acid sequences of all domain Ds are identical. In certain examples, domain D comprises an endogenous CH3 sequence. In some examples, where the fusion protein constructs are heterodimers or heterodimeric, two domain Ds with different amino acid sequences can associate, and separately comprise respectively orthogonal modifications in an endogenous CH3 sequence, wherein one domain D interacts with another domain D having a different sequence, and wherein neither of the two domains significantly interacts with another domain D (CH3 domain) lacking the orthogonal modification.

"Orthogonal modifications" or synonymously "orthogonal mutations" as described herein can be one or more engineered mutations in an amino acid sequence of an antibody domain that can increase the affinity of binding of a first domain having orthogonal modification for a second domain having a complementary orthogonal modification. In certain examples, the orthogonal modifications can decrease the affinity of a domain having the orthogonal modifications for a domain lacking the complementary orthogonal modifications. In certain examples, orthogonal modifications can be mutations in an endogenous antibody domain sequence. In a variety of examples, orthogonal modifications can be modifications of the N-terminus or C-terminus of an endogenous antibody domain sequence including, but not limited to, amino acid additions or deletions. In some examples, orthogonal modifications can include, but are not limited to, engineered disulfide bridges, knob-in-hole mutations, and charge-pair mutations. In some cases, orthogonal modifications can include a combination of orthogonal modifications selected from, but not limited to, engineered disulfide bridges, knob-in-hole mutations, and charge-pair mutations. In some examples, the orthogonal modifications can be combined with amino acid substitutions that reduce immunogenicity, such as isoallotype mutations.

In certain examples, where the fusion protein constructs are heterodimers, the orthogonal modifications can comprise mutations that generate engineered disulfide bridges between a first and a second domain. As described herein, "engineered disulfide bridges" can comprise mutations that provide non-endogenous cysteine amino acids in two or more domains such that a non-native disulfide bond forms when the two or more domains associate. In certain examples, engineered disulfide bridges can improve orthogonal association between specific domains. In some examples, the mutations that can generate engineered disulfide bridges can comprise a K392C mutation in one of a first or second CH3 domains, and a D399C in the other CH3 domain. In one example, the mutations that can generate engineered disulfide bridges can comprise a S354C mutation in one of a first or second CH3 domains, and a Y349C in the other CH3 domain. In another example, the mutations that can generate engineered disulfide bridges can comprise a 447C mutation in both the first and second CH3 domains that are provided by extension of the C-terminus of a CH3 domain incorporating a KSC tripeptide sequence.

In some examples, orthogonal modifications can comprise knob-hole (synonymously, knob-in-hole) mutations. As described herein, knob-hole mutations can comprise mutations that change the steric features of a first domain's surface such that the first domain will preferentially associate with a second domain having complementary steric mutations relative to association with domains without the complementary steric mutations. In various examples, knob-hole mutations can be combined with engineered disulfide bridges. In various embodiments, knob-hole mutations, isoallotype mutations, and engineered disulfide mutations can be combined to generate heterodimer fusion protein constructs. In certain examples, the knob-in-hole mutations can comprise a T366Y mutation in one CH3 domain, and a Y407T mutation in another CH3 domain. In certain examples, the knob-in-hole mutations can comprise a F405A in one CH3 domain, and a T394W in another CH3 domain. In certain embodiments, the knob-in-hole mutations can comprise a T366Y mutation and a F405A in one CH3 domain, and a T394W and a Y407T in another CH3 domain. In certain examples, the knob-in-hole mutations can comprise a T366W mutation in one CH3 domain, and a Y407A in another CH3 domain. In certain embodiments, the combined knob-in-hole mutations and engineered disulfide mutations can comprise S354C and T366W mutations in one CH3 domain, and a Y349C, T366S, L368A, and a Y407V mutation in another CH3 domain. In some examples, the combined knob-in-hole mutations, isoallotype mutations, and engineered disulfide mutations can comprise a S354C and T366W mutations in one CH3 domain, and a Y349C, D356E, L358M, T366S, L368A, and a Y407V mutation in another CH3 domain. In a variety of embodiments, orthogonal modifications can be charge-pair mutations. As used herein, charge-pair mutations can be mutations that affect the charge of an amino acid in a domain's surface such that the domain will preferentially associate with a second domain having complementary charge-pair mutations relative to association with domains without the complementary charge-pair mutations. In certain embodiments, charge-pair mutations can improve orthogonal association between specific domains. In certain embodiments, charge-pair mutations can improve stability between specific domains. In some examples, the charge-pair mutations are a T366K mutation in one CH3 domain, and a L351D mutation in another CH3 domain.

Monomeric Fusion Protein Constructs

Figure 2:
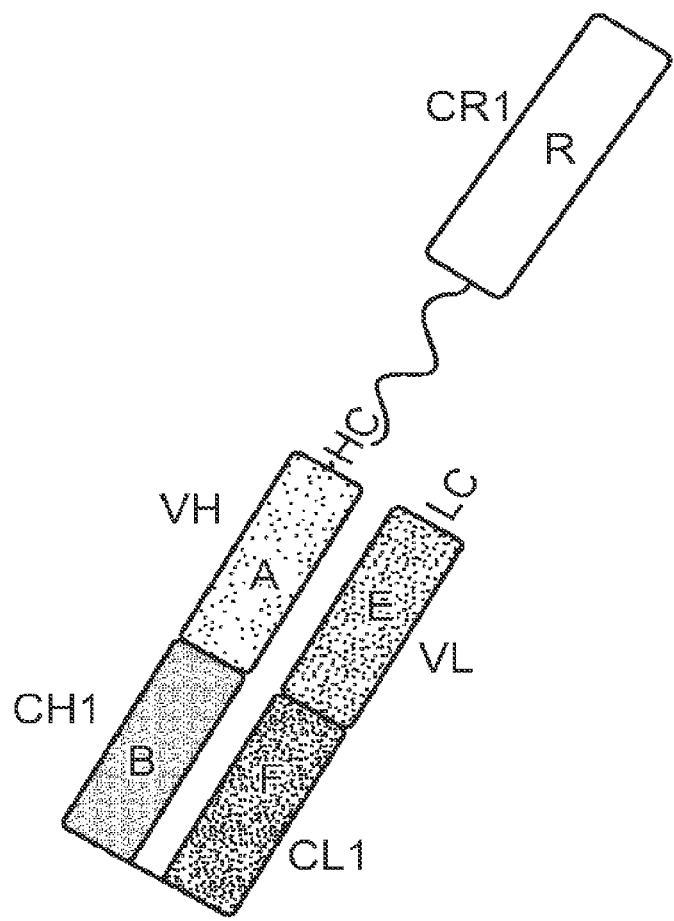
FIG. 2 illustrates an exemplary monomeric fusion protein construct of this disclosure, comprising a linkage between the heavy chain of a targeting moiety and a complement modulator polypeptide. The complement modulator polypeptide is connected to the N-terminus of the heavy chain via a linker.
Figure 3:
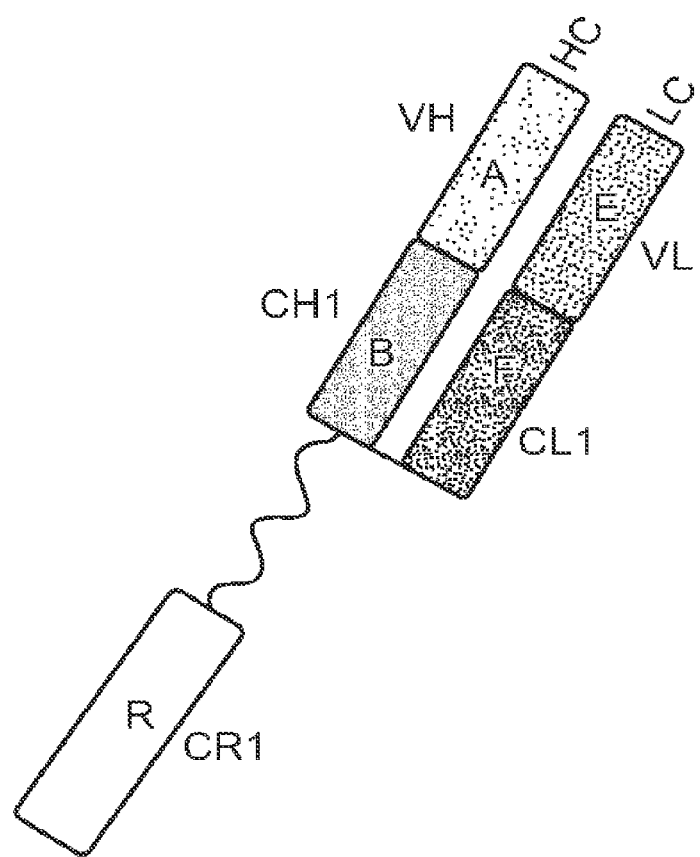
FIG. 3 illustrates an exemplary monomeric fusion protein construct of this disclosure, comprising a linkage between the heavy chain of a targeting moiety and a complement modulator polypeptide. The complement modulator polypeptide is connected to the C-terminus of the heavy chain via a linker.

An exemplary monomeric fusion protein construct is illustrated in FIGS. 2-3, comprising a first and a second polypeptide, wherein the first polypeptide comprises the following domains: domain A, domain B, and domain R; and the second polypeptide comprises the following domains: domain E and domain. F. In the illustrated fusion protein construct of FIG. 2, domain A comprises a heavy chain variable region amino acid sequence (VH), or an antigen-binding fragment thereof, domain B comprises a heavy chain CH1 constant region amino acid sequence, and domain R comprises a complement modulator polypeptide, domain E comprises a light chain variable region amino acid sequence (VL), or an antigen binding fragment thereof, and domain F comprises a light chain constant region amino acid sequence (CL1). Further, domains B and F, of the first and second polypeptides, respectively, can be linked via one or more disulfide bonds. The domains of the first polypeptide are arranged, from N-terminus to C-terminus, in an A-B-R orientation or an R-A-B orientation, and the domains of the second polypeptide are arranged, from N-terminus to C-terminus, in an E-F orientation. In the example shown in FIG.

2, the monomeric fusion protein construct comprises a linkage between domains A and R, for example, a chemical linkage or through a peptide linker. In an additional example is provided a monomeric fusion protein construct, as in FIG. 3, comprising linkage between domain R and domain B.

Figure 4:
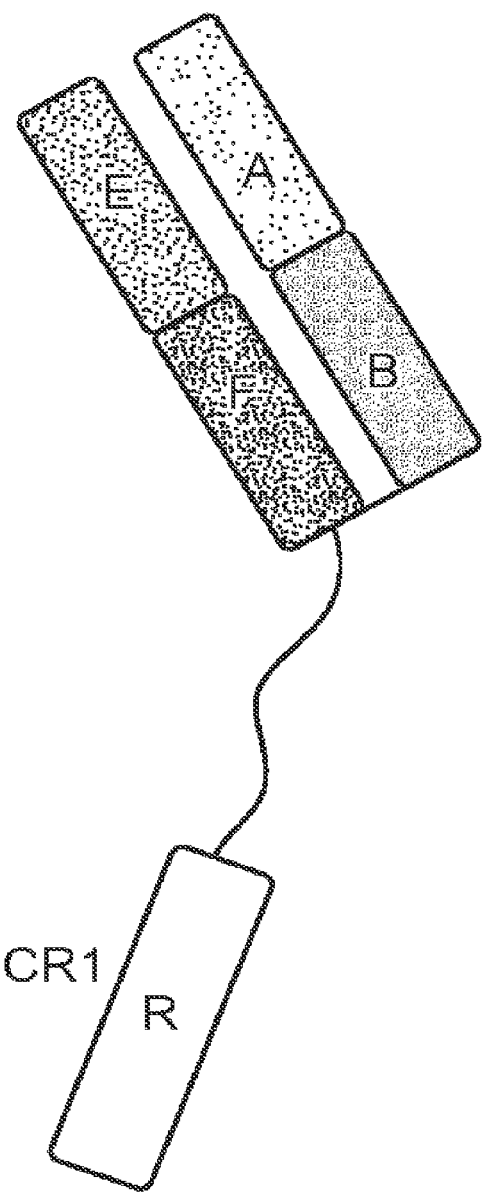
FIG. 4 illustrates an exemplary monomeric fusion protein construct of this disclosure, comprising a linkage between the light chain of a targeting moiety and a complement modulator polypeptide. The complement modulator polypeptide is connected to the C-terminus of the light chain via a linker.

A further exemplary monomeric fusion protein construct is illustrated in FIGS. 1 and 4, comprising a first and a second polypeptide, wherein the first polypeptide comprises the following domains: domain A, and domain B; and the second polypeptide comprises the following domains: domain E, domain F, and domain R. The domains B and F, of the first and second polypeptides, respectively, can be linked via one or more disulfide bonds. The domains of the first polypeptide are arranged, from N-terminus to C-terminus, in an A-B orientation, and the domains of the second polypeptide are arranged, from N-terminus to C-terminus, in an E-F orientation. In the example shown in FIG. 4, the monomeric fusion protein construct comprises a linkage between domains F and R, for example, a chemical linkage or through a peptide linker. In an additional example is provided a monomeric fusion protein construct, as in FIG. 1 comprising a linkage between domains E and R.

In additional examples, are provided fusion protein constructs comprising more than complement modulator polypeptide, i.e., more than one domain R. In such cases, the fusion protein construct comprises a first polypeptide with domains A, B, and a first complement modulator polypeptide (domain R1); a second polypeptide with domains E, F, and a second complement modulator polypeptide (domain R2); wherein the fusion protein construct comprises a linkage between domain R1 and domain A, or between domain R1 and domain B; and between domain R2 and domain F, or between domain R2 and domain E.

In a further example, the fusion protein construct comprises a first polypeptide comprising domain A, domain B, a first complement modulator polypeptide (domain R1), and a second complement modulator polypeptide (domain. R2); a second polypeptide comprising domain E, domain F, a third complement modulator polypeptide (domain R3), and a fourth complement modulator polypeptide (domain R4). The fusion protein construct can comprise linkages between domain R1 and domain B and between domain R2 and domain A, or between domain R2 and domain B and between domain R1 and domain A; and between domain R3 and domain E and between domain R4 and domain F; or between domain R4 and domain E and between domain R3 and domain E.

Figure 5:
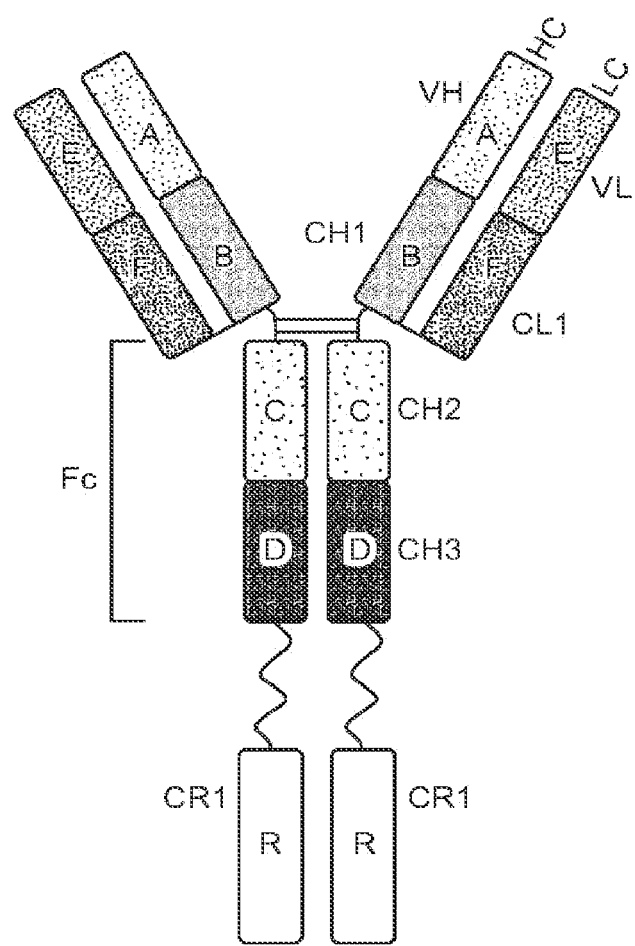
FIG. 5 illustrates an exemplary tetravalent homodimeric fusion protein construct of this disclosure, comprising a linkage between the heavy chain of a targeting moiety and a complement modulator polypeptide. The complement modulator polypeptide is connected to the C-terminus of the heavy chain via a linker.
Figure 6:
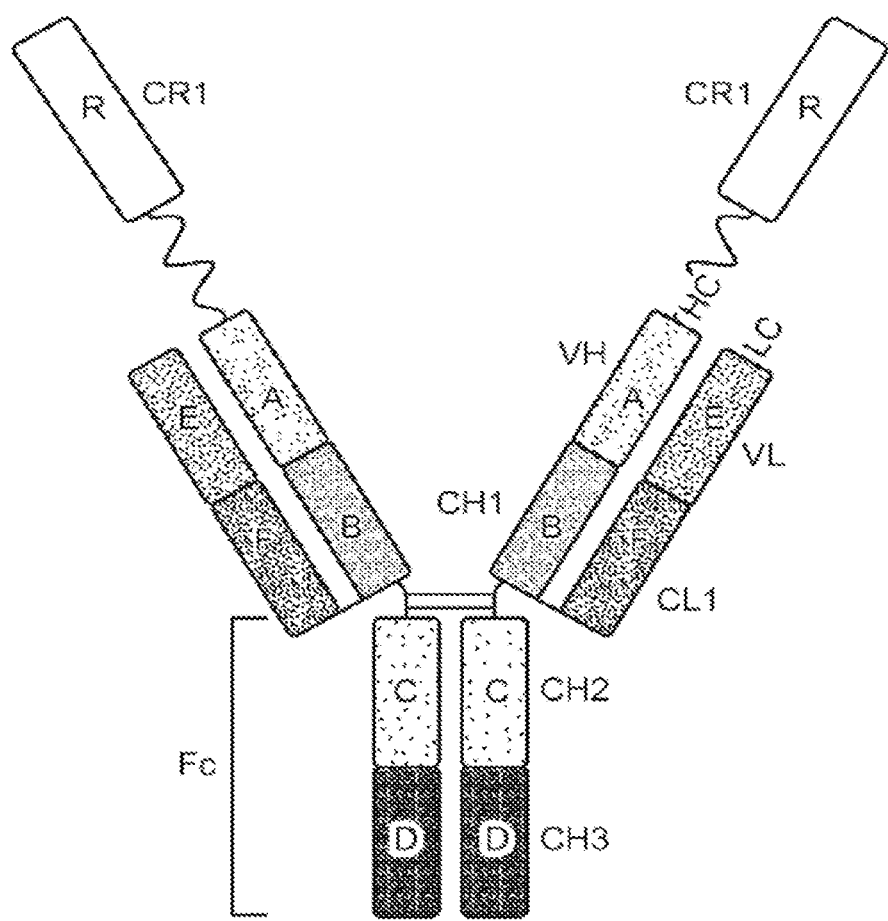
FIG. 6 illustrates an exemplary tetravalent homodimeric fusion protein construct of this disclosure, comprising a linkage between the heavy chain of a targeting moiety and a complement modulator polypeptide. The complement modulator polypeptide is connected to the N-terminus of the heavy chain via a linker.

Homodimer Fusion Protein Constructs Comprising Complement Modulators Attached to a Heavy Chain Polypeptide Exemplary tetravalent homodimer fusion protein constructs are illustrated in. FIGS. 5-6, comprising two polypeptides, each comprising a first polypeptide comprising domain A, domain B, a hinge region, domain C, domain D, and domain R; a second polypeptide comprising domain E, and domain F, wherein the first polypeptide is arranged, from N-terminus to C-terminus, in an A-B-hinge domain-C-D-R orientation comprising a linkage between domain D and domain R; or in an R-A-B-hinge region-C-D orientation comprising a linkage between domain R and domain A. Domains B and F of the first polypeptide and the second polypeptide can be linked via one or more disulfide bonds. The second polypeptide can be arranged, from N-terminus to C-terminus, in an E-F orientation. The two first polypeptides can be linked together via one or more disulfide bonds at the hinge region. Further exemplary tetravalent homodimer fusion protein constructs comprise two polypeptides, each comprising a first polypeptide comprising domain A, domain. B, a hinge region, domain C, and domain R; a second polypeptide comprising domain E, and domain F, wherein the first polypeptide is arranged, from N-terminus to C-terminus, in an A-B-hinge domain-C-R orientation comprising a linkage between domain D and domain R; or in an R-A-B-hinge region-C orientation comprising a linkage between domain R and domain A. Domains B and F of the first polypeptide and the second polypeptide can be linked via one or more disulfide bonds. The second polypeptide can be arranged, from N-terminus to C-terminus, in an E-F orientation. The two first polypeptides can be linked together via one or more disulfide bonds at the hinge region.

Further exemplary tetravalent homodimer fusion protein construct comprise two polypeptides, each polypeptide chain comprising a first polypeptide comprising domain A, domain B, a hinge region, and domain R; a second polypeptide comprising domain E, and domain F, wherein the first polypeptide is arranged, from N-terminus to C-terminus, in an A-B-hinge domain-R orientation comprising a linkage between the hinge region and domain R; or in an R-A-B-hinge region orientation comprising a linkage between domain R and domain A. The second polypeptide can be arranged, from N-terminus to C-terminus, in an E-F orientation. Domains B and F of the first polypeptide and the second polypeptide can be linked via one or more disulfide bonds. The two first polypeptides can be linked together via one or more disulfide bonds at the hinge region.

Figure 7:
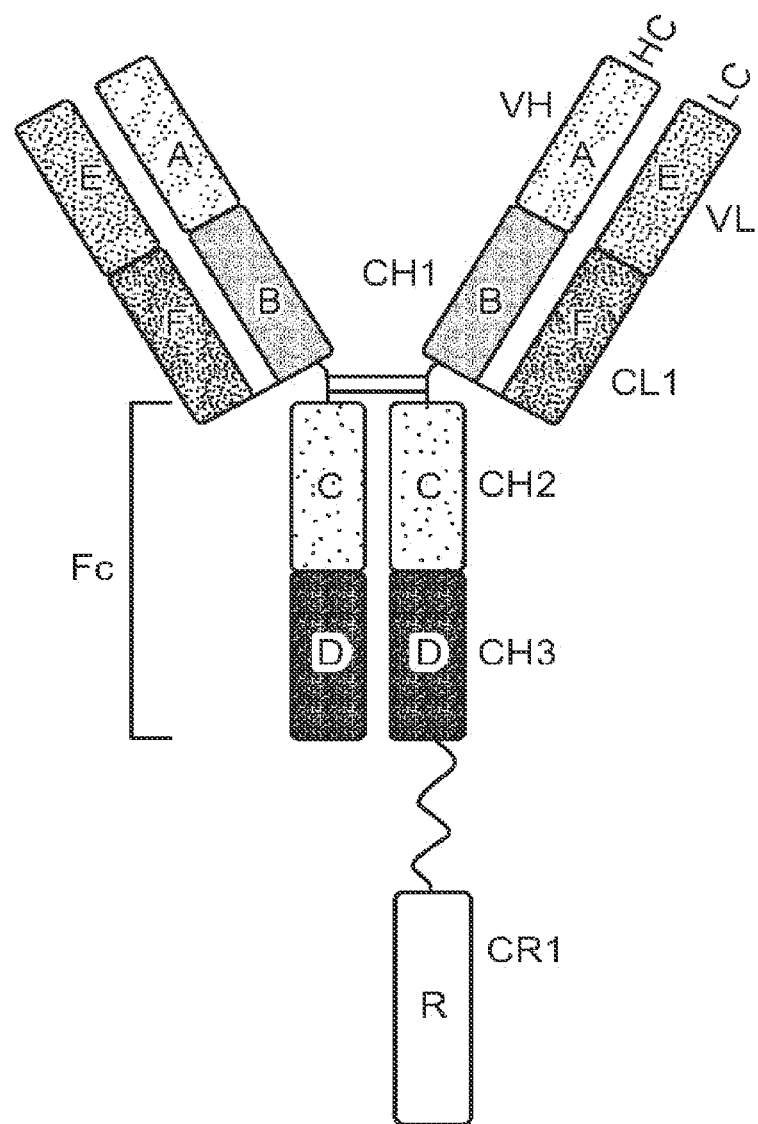
FIG. 7 illustrates an exemplary trivalent heterodimeric fusion protein construct of this disclosure, comprising a linkage between the heavy chain of a targeting moiety and a complement modulator polypeptide. The complement modulator polypeptide is connected to the C-terminus of the heavy chain via a linker.
Figure 8:
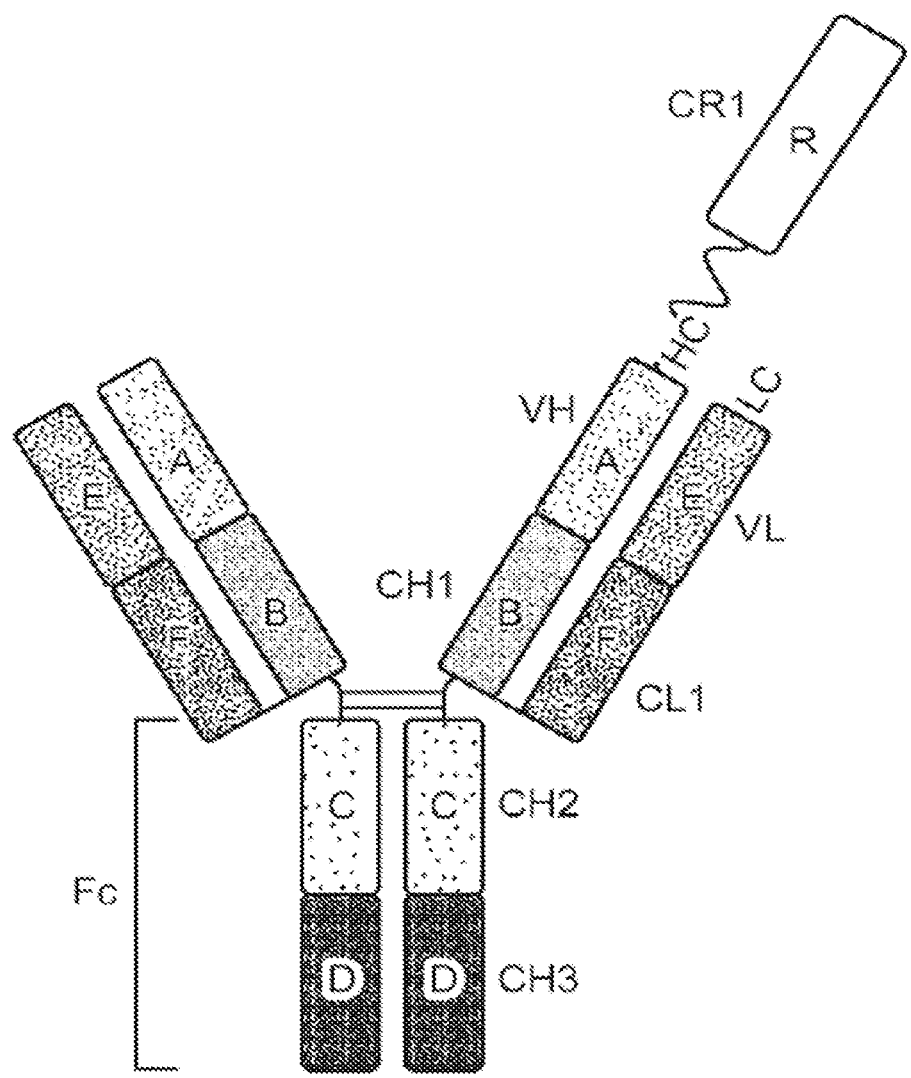
FIG. 8 illustrates an exemplary trivalent heterodimeric fusion protein construct of this disclosure, comprising a linkage between the heavy chain of a targeting moiety and a complement modulator polypeptide. The complement modulator polypeptide is connected to the N-terminus of the heavy chain via a linker.

Heterodimer Fusion Protein Constructs Comprising Complement Modulators Attached to a Heavy Chain Polypeptide Exemplary trivalent heterodimer fusion protein constructs are illustrated in FIGS. 7-8, comprising a first polypeptide, a second polypeptide, a third polypeptide, and a fourth polypeptide, the first polypeptide comprising: domain A, domain B, hinge region, domain C, domain I), and domain R, arranged, from N-terminus to C-terminus in a R-A-B-hinge region-C-D orientation comprising a linkage between domain A and domain R (as in FIG. 8), or in an A-B-hinge region-C-D-R orientation comprising a linkage between domain D and domain R (as in FIG. 7); the second polypeptide comprising domain E, and domain F, arranged from N-terminus to C-terminus in an E-F orientation; the third polypeptide comprising domain A, domain B, hinge region, domain C, and domain D, arranged from N-terminus to C-terminus in an A-B-hinge region-C-D orientation; and the fourth polypeptide comprising domain E and domain F, arranged from N-terminus to C-terminus in an E-F orientation. Domains B and F of the first polypeptide and the second polypeptide can be linked via one or more disulfide bonds and domains B and F of the third and fourth polypeptide can be linked via one or more disulfide bonds. The first and the third polypeptide can be linked together via one or more disulfide bonds, at the hinge region.

Further exemplary trivalent heterodimer fusion protein constructs comprise a first polypeptide, a second polypeptide, a third polypeptide, and a fourth polypeptide, the first polypeptide comprising: domain A, domain B, hinge region, domain C, and domain R, arranged, from N-terminus to C-terminus in a R-A-B-hinge region-C orientation comprising a linkage between domain A and domain R, or in an A-B-hinge region-C-orientation comprising a linkage between domain C and domain R; the second polypeptide comprising domain E, and domain F, arranged from N-terminus to C-terminus in an E-F orientation; the third polypeptide comprising domain A, domain B, hinge region, and domain C, arranged from N-terminus to C-terminus in an A-B-hinge region-C orientation; and the fourth polypeptide comprising domain F and domain F, arranged from N-terminus to C-terminus in an E-F orientation. Domains B and F of the first polypeptide and the second polypeptide can be linked via one or more disulfide bonds and domains B and F of the third and fourth polypeptide can be linked via one or more disulfide bonds. The first and the third polypeptide can be linked together via one or more disulfide bonds, at the hinge region.

Further exemplary trivalent heterodimer fusion protein construct comprise a first polypeptide, a second polypeptide, a third polypeptide, and a fourth polypeptide, the first polypeptide comprising: domain A, domain B, hinge region, and domain R, arranged, from N-terminus to C-terminus in a R-A-B-hinge region orientation comprising a linkage between domain A and domain R, or in an A-B-hinge region-R orientation comprising a linkage between the hinge region and domain R; the second polypeptide comprising domain E, and domain F, arranged from N-terminus to C-terminus in an E-F orientation; the third polypeptide comprising domain A, domain B, and hinge region, arranged from N-terminus to C-terminus in an A-B-hinge region orientation; and the fourth polypeptide comprising domain F and domain F, arranged from N-terminus to C-terminus in an F-F orientation. Domains B and F of the first polypeptide and the second polypeptide can be linked via one or more disulfide bonds and domains B and F of the third and fourth polypeptide can be linked via one or more disulfide bonds. The third polypeptide can be linked together via one or more disulfide bonds, at the hinge region.

Figure 9:
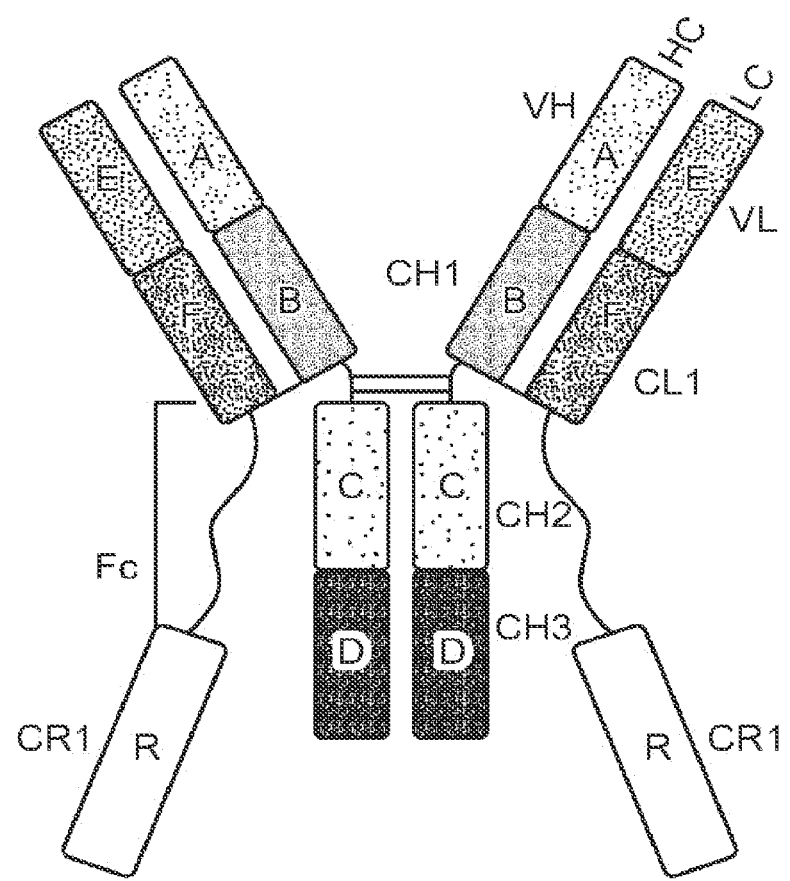
FIG. 9 illustrates an exemplary tetravalent homodimeric fusion protein construct of this disclosure, comprising a linkage between the light chain of a targeting moiety and a complement modulator polypeptide. The complement modulator polypeptide is connected to the C-terminus of the light chain via a linker.
Figure 10:
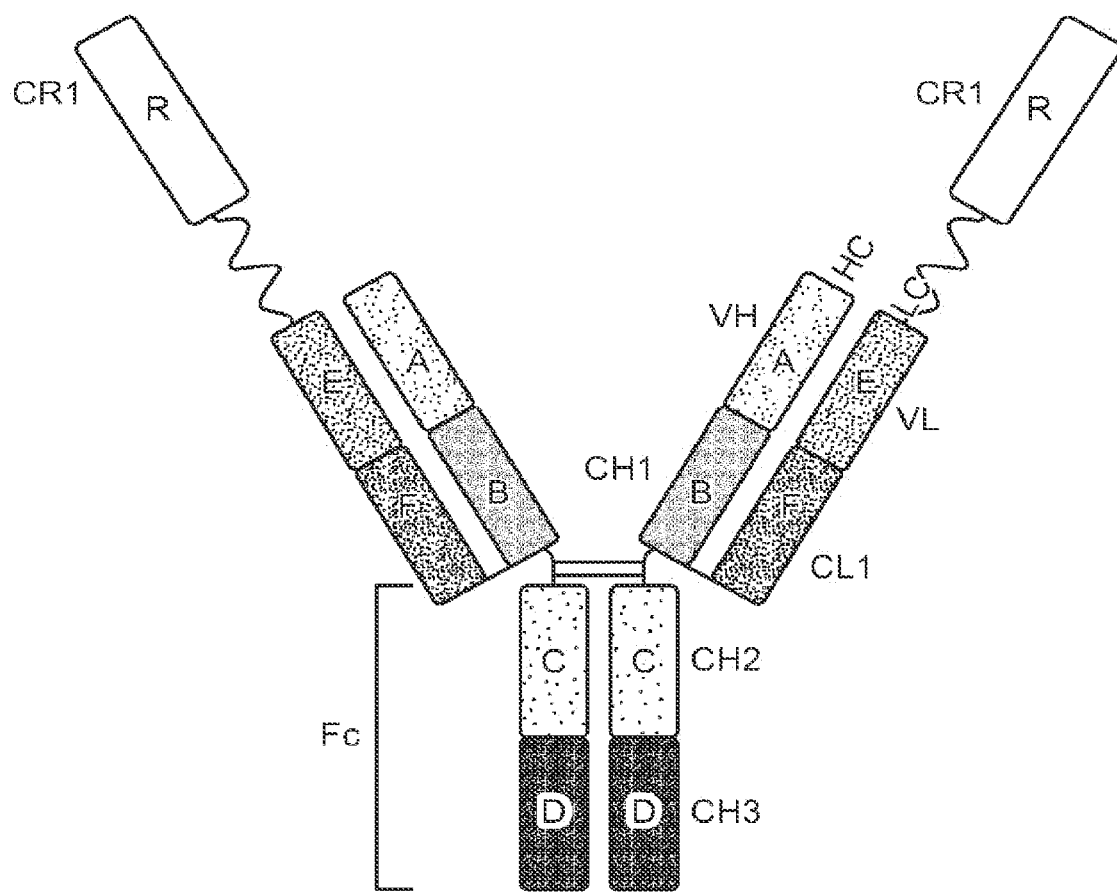
FIG. 10 illustrates an exemplary tetravalent homodimeric fusion protein construct of this disclosure, comprising a linkage between the light chain of a targeting moiety and a complement modulator polypeptide. The complement modulator polypeptide is connected to the N-terminus of the light chain via a linker.

Fusion Protein Constructs Comprising Complement Modulators Attached to a Light Polypeptide Further exemplary tetravalent homodimeric fusion protein construct, illustrated in FIG. 9, comprises two polypeptides, each comprising a first polypeptide and a second polypeptide, the first polypeptide comprises domain A, domain B, a hinge region, domain C and domain D; a second polypeptide comprising domain E, domain F, and domain R, wherein the first polypeptide is arranged, from N-terminus to C-terminus, in an A-B-hinge domain-C-D orientation; the second polypeptide can be arranged, from N-terminus to C-terminus, in an E-F-R orientation comprising a linkage between domain F and domain R (as shown in FIG. 9), or in an R-E-F orientation comprising a linkage between domain F and domain R (as shown in FIG. 10). Domains B and F of the first polypeptide and the second polypeptide can be linked via one or more disulfide bonds. The two first polypeptides can be linked together via one or more disulfide bonds at the hinge region.

Further exemplary tetravalent homodimeric fusion protein constructs comprise two polypeptides, each comprising a first polypeptide and a second polypeptide, the first polypeptide comprises domain A, domain B, a hinge region, and domain C; a second polypeptide comprising domain E, domain F, and domain R, wherein the first polypeptide is arranged, from N-terminus to C-terminus, in an A-B-hinge domain-C orientation; the second polypeptide can be arranged, from N-terminus to C-terminus, in an E-F-R orientation comprising a linkage between domain F and domain R, or in an R-E-F orientation comprising a linkage between domain E and domain R. Domains B and F of the first polypeptide and the second polypeptide can be linked via one or more disulfide bonds. The two first polypeptides can be linked together via one or more disulfide bonds at the hinge region.

Further exemplary tetravalent homodimeric fusion protein constructs comprise two polypeptides, each comprising a first polypeptide and a second polypeptide, the first polypeptide comprises domain A, domain B, and a hinge region; a second polypeptide comprising domain E, domain F, and domain R, wherein the first polypeptide is arranged, from N-terminus to C-terminus, in an A-B-hinge region orientation; the second polypeptide can be arranged, from N-terminus to C-terminus, in an E-F-R orientation comprising a linkage between domain F and domain R, or in an R-E-F orientation comprising a linkage between domain E and domain R. Domains B and F of the first polypeptide and the second polypeptide can be linked via one or more disulfide bonds. The two first polypeptides can be linked together via one or more disulfide bonds at the hinge region.

Figure 11:
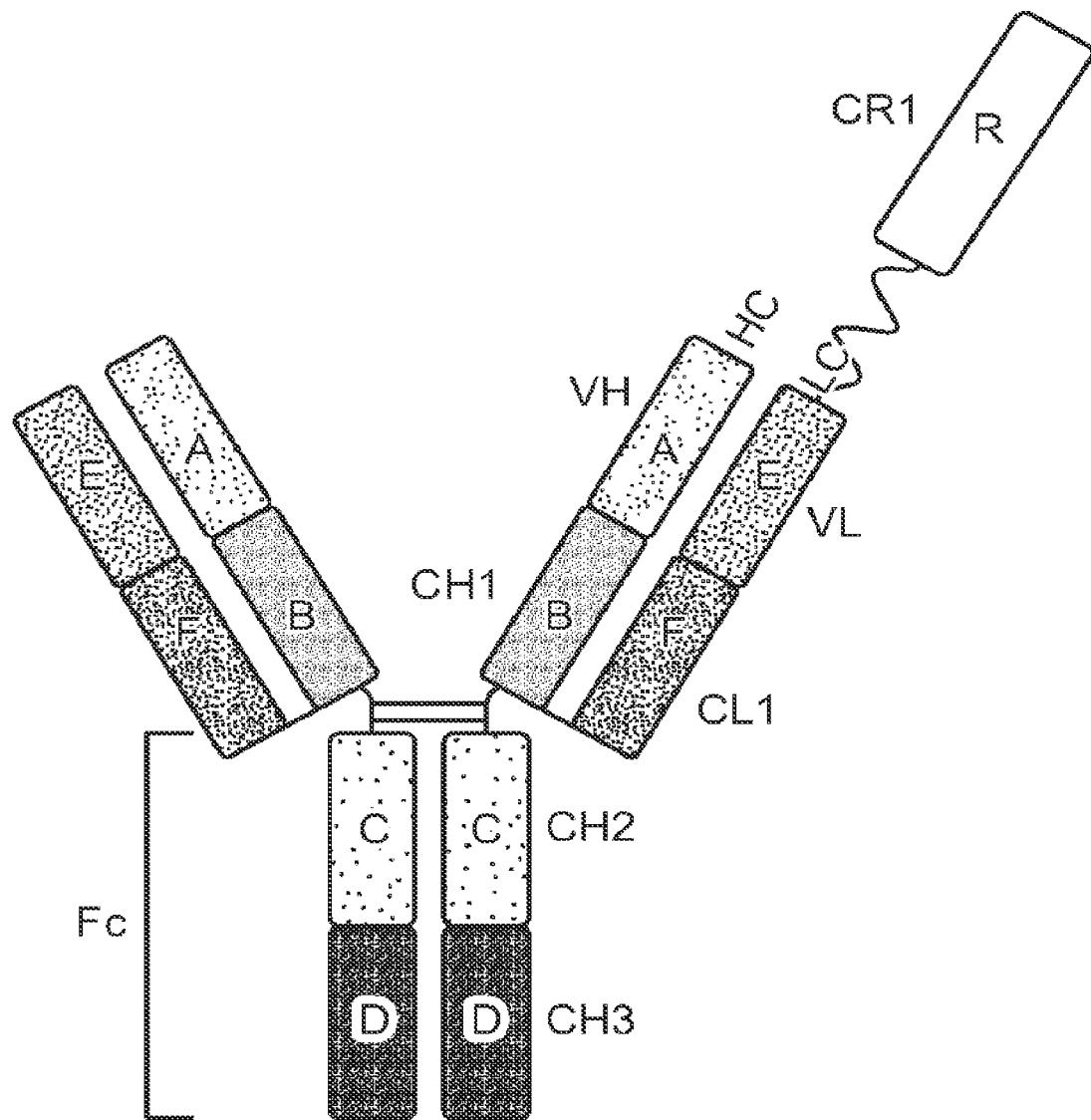
FIG. 11 illustrates an exemplary trivalent heterodimeric fusion protein construct of this disclosure, comprising a linkage between the light chain of a targeting moiety and a complement modulator polypeptide. The complement modulator polypeptide is connected to the N-terminus of the light chain via a linker.
Figure 12:
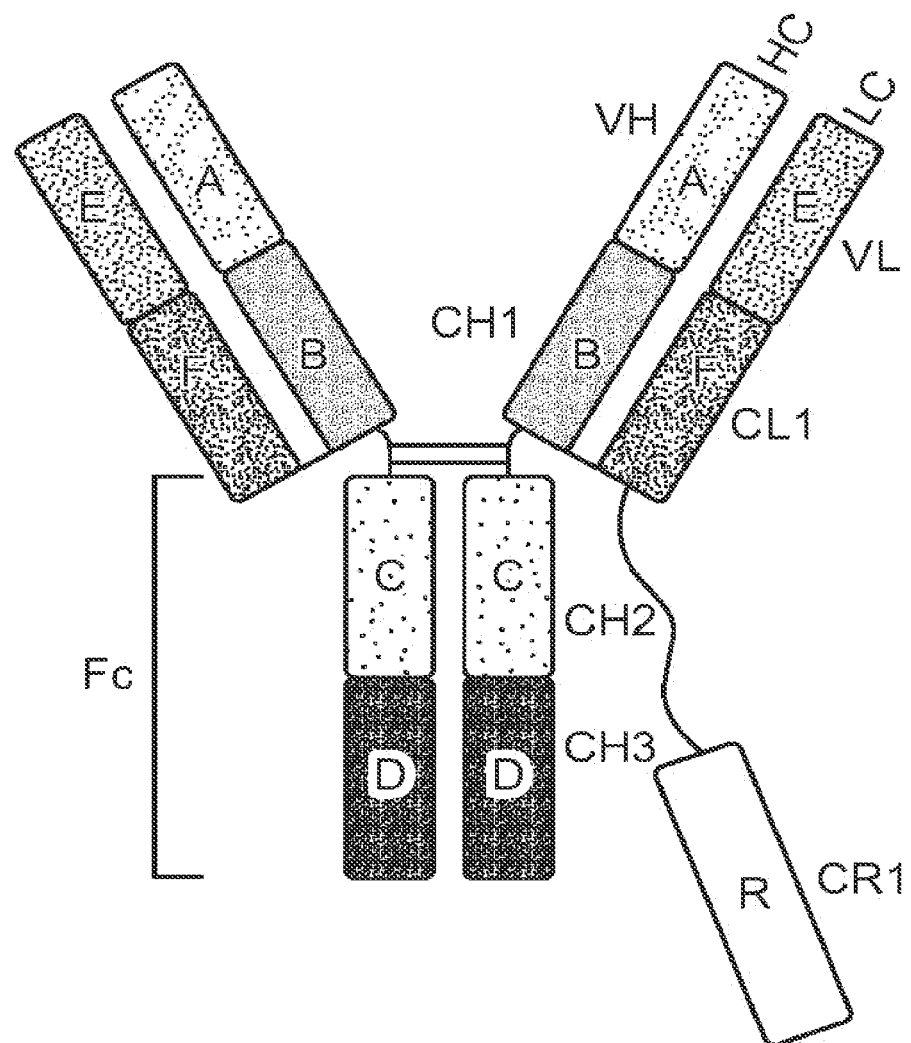
FIG. 12 illustrates an exemplary trivalent heterodimeric fusion protein construct of this disclosure, comprising a linkage between the light chain of a targeting moiety and a complement modulator polypeptide. The complement modulator polypeptide is connected to the C-terminus of the light chain via a linker.

Provided are exemplary heterodimeric constructs comprising a first polypeptide, a second polypeptide, a third polypeptide, and a fourth polypeptide, the first polypeptide comprising: domain A, domain B, hinge region, domain C, domain D; the second polypeptide comprises domain E, domain F, and domain R; the third polypeptide comprises domain A, domain B, hinge region, domain C, and domain D; the fourth polypeptide comprises domain E and domain F; wherein the first polypeptide and the third polypeptides are arranged, from N-terminus to C-terminus, in an A-B-hinge region-C-D orientation; the second polypeptide is arranged, from N-terminus to C-terminus in an E-F-R orientation comprising a linkage between domain F and domain R (as shown in FIG. 12), or in an R-E-F orientation comprising a linkage between domain E and domain R (as shown in FIG. 11); and the fourth polypeptide is arranged, from the N-terminus to C-terminus, in an E-F orientation. Domains B and F of the first polypeptide and the second polypeptide can be linked via one or more disulfide bonds and domains B and F of the third and fourth polypeptide can be linked via one or more disulfide bonds. The first and the third polypeptide can be linked together via one or more disulfide bonds, at the hinge region.

Provided are exemplary heterodimeric constructs comprising a first polypeptide, a second polypeptide, a third polypeptide, and a fourth polypeptide, the first polypeptide comprising: domain A, domain B, hinge region, and domain C; the second polypeptide comprises domain E, domain F, and domain R; the third polypeptide comprises domain A, domain B, hinge region, and domain C; the fourth polypeptide comprises domain E and domain F; wherein the first polypeptide and the third polypeptide are arranged, from N-terminus to C-terminus, in an A-B-hinge region-C orientation; the second polypeptide is arranged, from N-terminus to C-terminus in an E-F-R orientation comprising a linkage between domain F and domain R, or in an R-E-F orientation comprising a linkage between domain E and domain R; and the fourth polypeptide is arranged, from the N-terminus to C-terminus, in an E-F orientation. Domains B and F of the first polypeptide and the second polypeptide can be linked via one or more disulfide bonds and domains B and F of the third and fourth polypeptide can be linked via one or more disulfide bonds. The first and the third polypeptide can be linked together via one or more disulfide bonds, at the hinge region.

Provided are exemplary heterodimeric constructs comprising a first polypeptide, a second polypeptide, a third polypeptide, and a fourth polypeptide, the first polypeptide comprising: domain A, domain B, and hinge region; the second polypeptide comprises domain E, domain F, and domain R; the third polypeptide comprises domain A, domain B, and hinge region; the fourth polypeptide comprises domain E and domain F; wherein the first polypeptide and the third polypeptide are arranged, from N-terminus to C-terminus, in an A-B-hinge region orientation; the second polypeptide is arranged, from N-terminus to C-terminus in an E-F-R orientation comprising a linkage between domain F and domain R, or in an R-E-F orientation comprising a linkage between domain E and domain R; and the fourth polypeptide is arranged, from the N-terminus to C-terminus, in an E-F orientation. Domains B and F of the first polypeptide and the second polypeptide can be linked via one or more disulfide bonds and domains B and F of the third and fourth polypeptide can be linked via one or more disulfide bonds. The first and the third polypeptide can be linked together via one or more disulfide bonds, at the hinge region.

Figure 13:
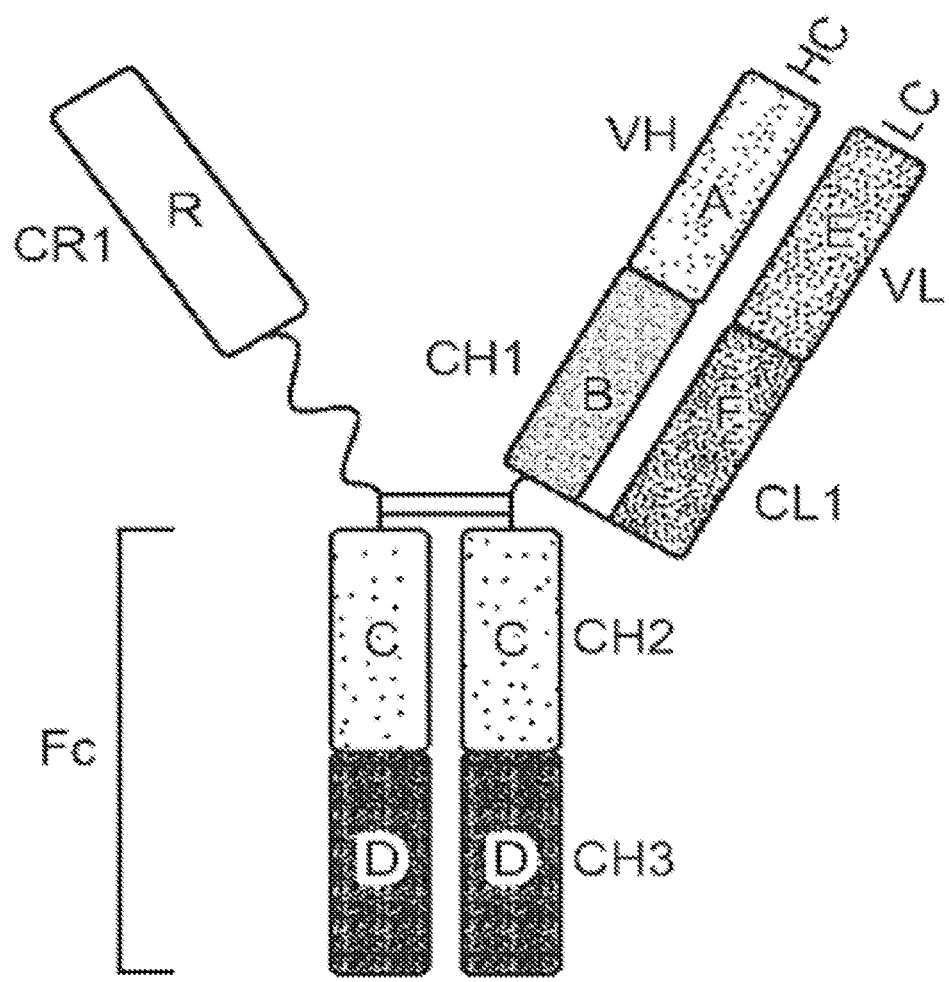
FIG. 13 illustrates an exemplary fusion protein construct of this disclosure, comprising a linkage between the N-terminus of the Fc region of a targeting moiety and a complement modulator polypeptide.
Figure 14:
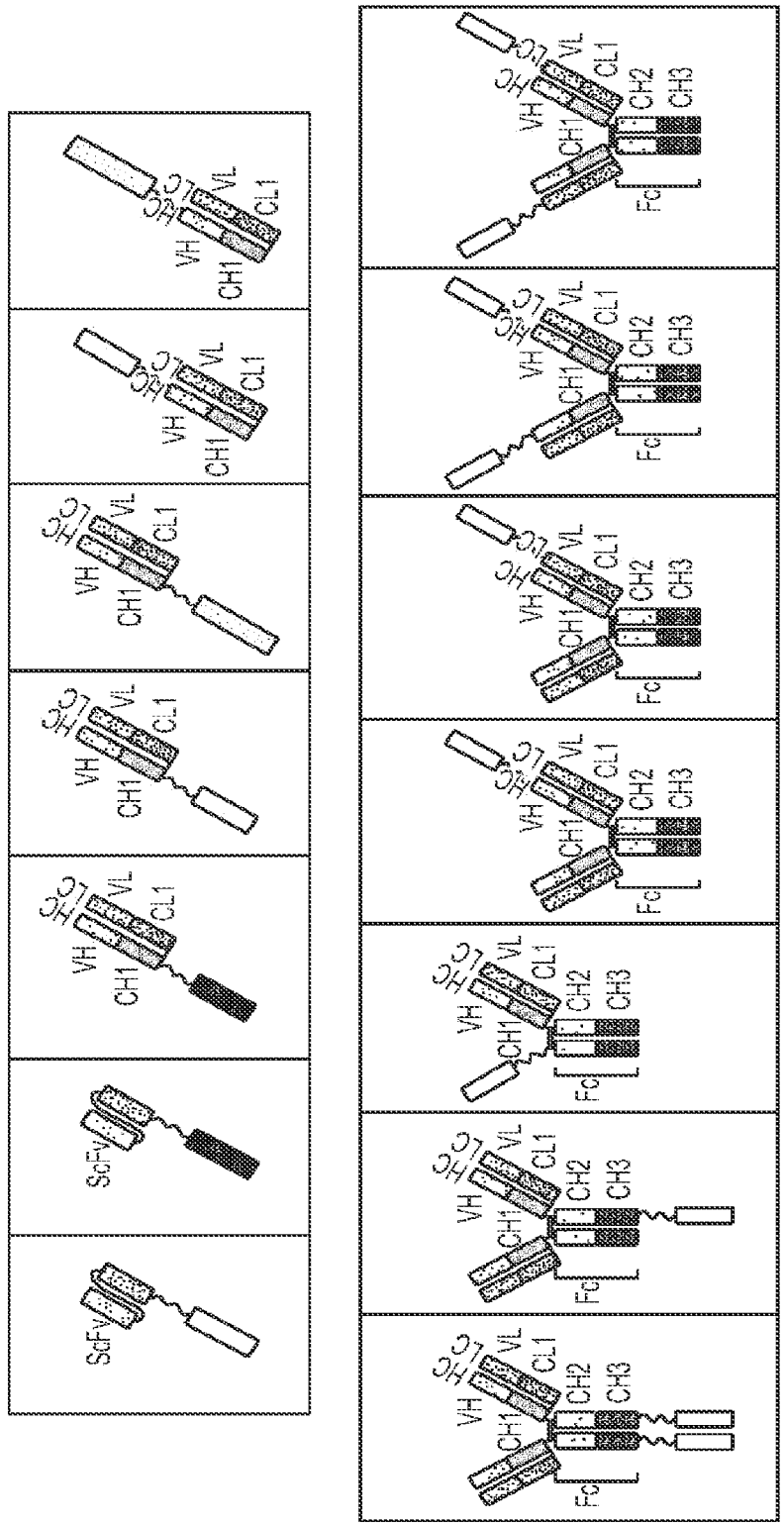
FIG. 14 illustrates exemplary designs for C2-complement modulator fusion protein constructs of this disclosure.
Figure 15:
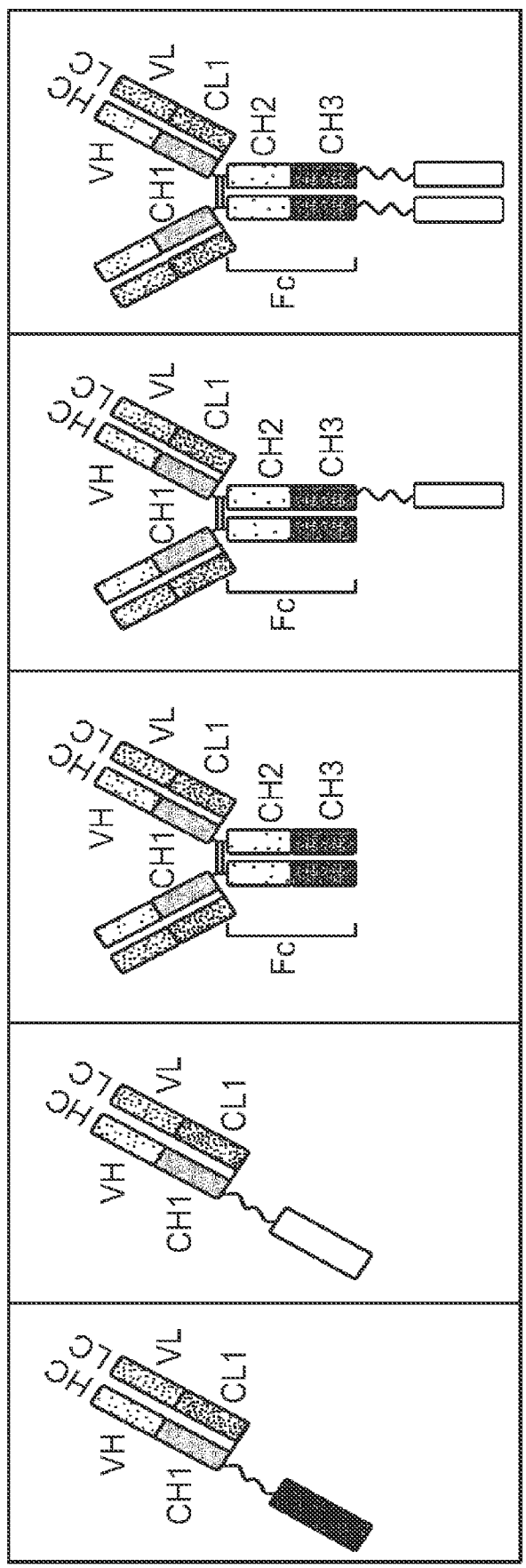
FIG. 15 illustrates exemplary designs for anti-C3d-complement modulator fusion protein constructs of this disclosure.
Figure 16:
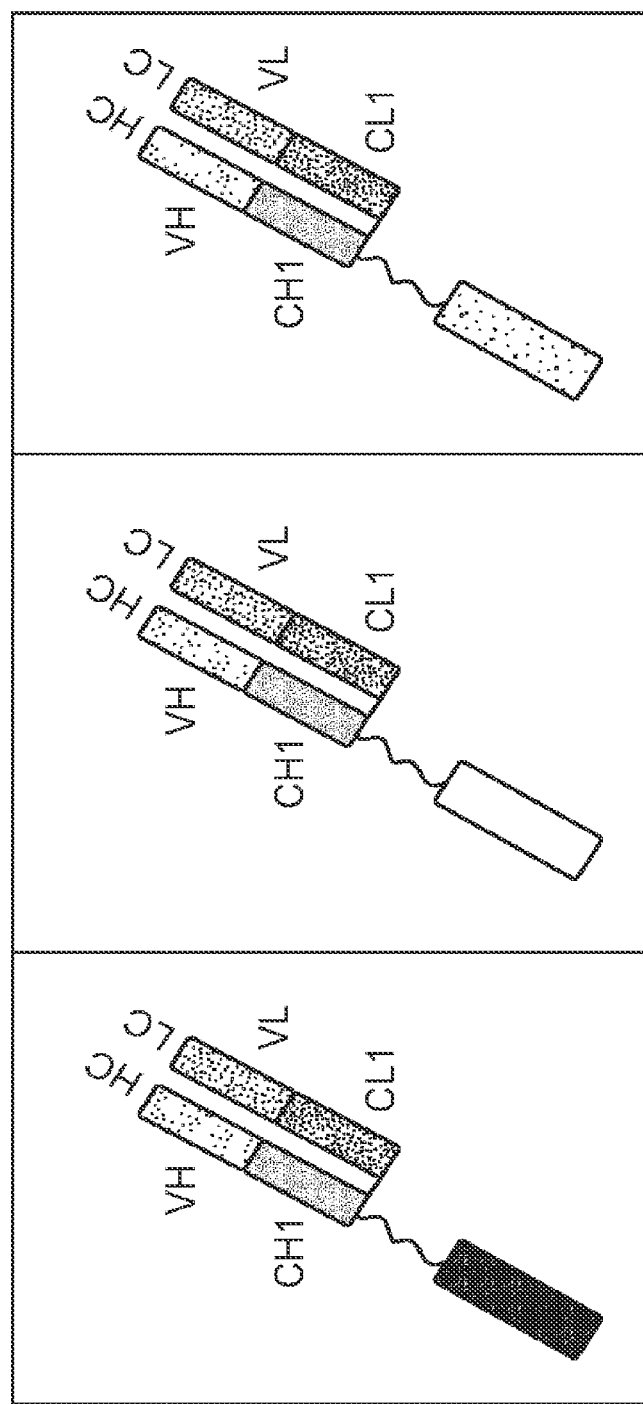
FIG. 16 illustrates exemplary designs for anti-C3d complement modulator fusion protein constructs of this disclosure.
Figure 17:
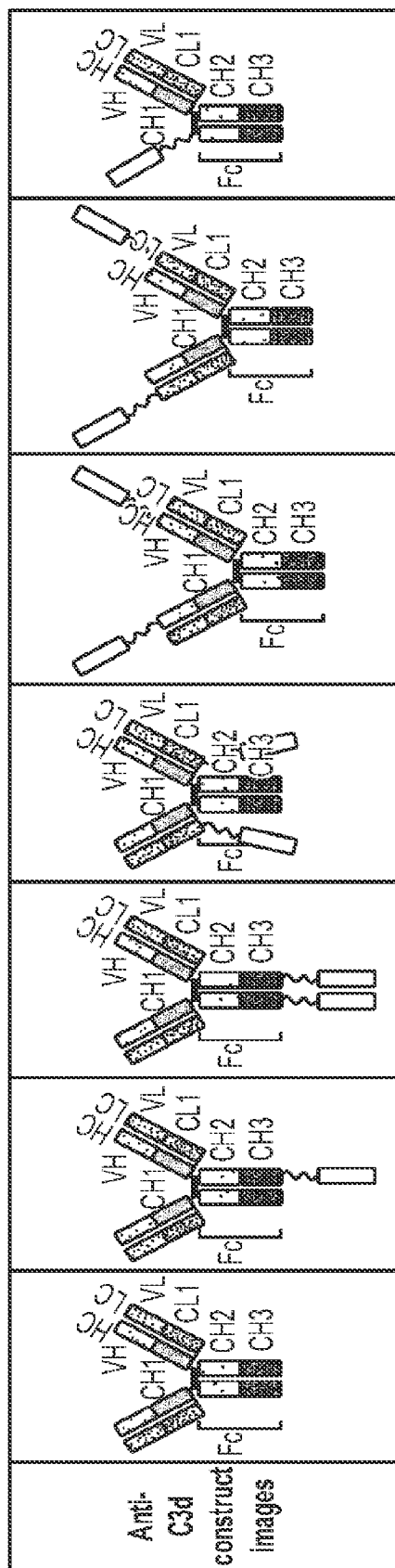
FIG. 17 illustrates exemplary designs for anti-C3d complement modulator fusion protein constructs of this disclosure.
Figure 18:
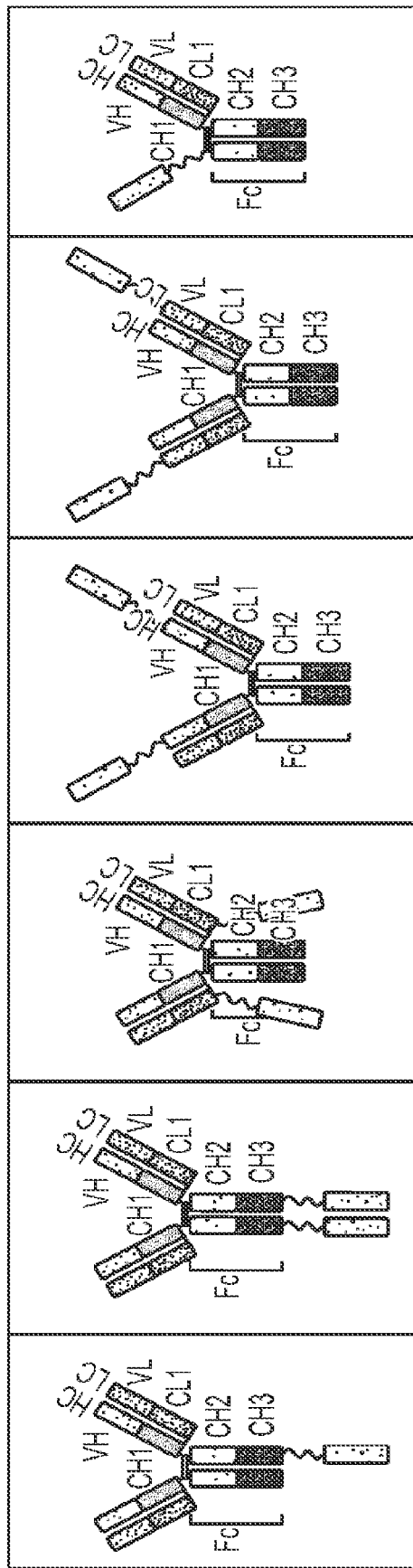
FIG. 18 illustrates exemplary designs for anti-C3d complement modulator fusion protein constructs of this disclosure.

Fusion Protein Constructs Comprising Complement Modulators Attached to the Constant Region of an Antibody Provided herein is an exemplary fusion protein, illustrated in FIG. 13, comprising a first polypeptide, a second polypeptide, and a third polypeptide; the first polypeptide comprising: domain R, a hinge region, domain C, and a domain D; the second polypeptide comprising: domain A, domain B, a hinge region, domain C, and domain D; the third polypeptide comprising: domain E and domain F, wherein, the first polypeptide can be arranged, from N-terminus to C-terminus in an R-hinge region-C-D orientation comprising a linkage between domain R and the hinge region; the second polypeptide is arranged, from N-terminus to C-terminus in an A-B-hinge region-C-D orientation; the third polypeptide can be arranged, from N-terminus to C-terminus in an E-F orientation. Domains B and F of the second polypeptide and the third polypeptide, respectively, can be linked via one or more disulfide bonds. The first and the second polypeptide can be linked together via one or more disulfide bonds, at the hinge region. In some examples, the fusion protein comprising a linkage between the complement modulator and the constant region, wherein the complement modulator can be CR1 (1-10), CR1 (1-17), factor H, MCP, or DAF connected to the constant region of an immunoglobulin molecule, comprising, for example, two CH3 domains, two CH2 domains, and the hinge region.

Exemplary Constructs

Figure 30:
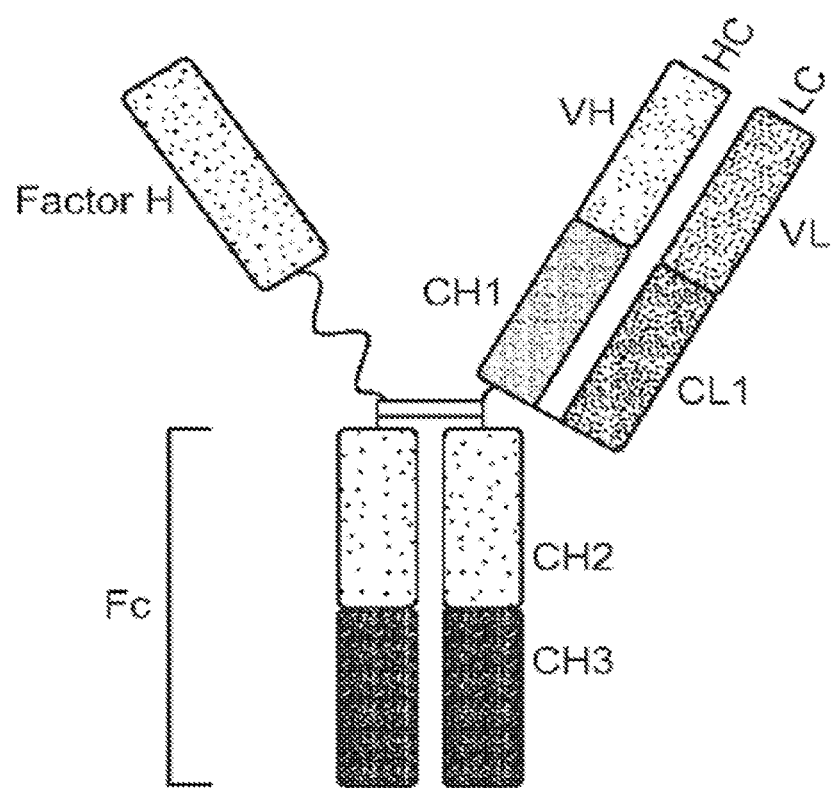
FIG. 30 illustrates an exemplary design for IgG1-complement modulator (factor H) fusion protein constructs of this disclosure, where the complement modulator (factor H) is connected to the hinge region of the IgG1 via a linker.
Figure 31A:
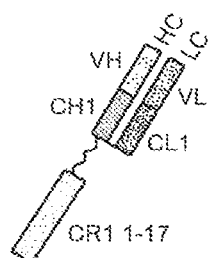
FIGS. 31A-31F illustrates exemplary designs for anti-C3d (3d8b)-complement modulator (CR1 1-17) fusion protein constructs of this disclosure.
Figure 31B:
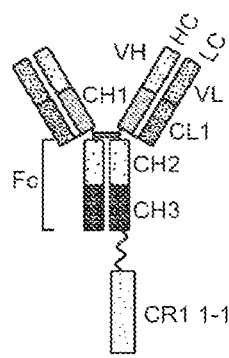
Figure 31C:
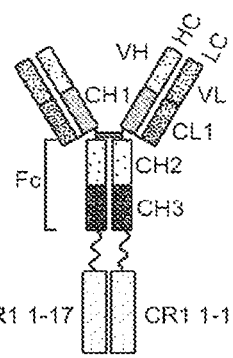
Figure 31D:
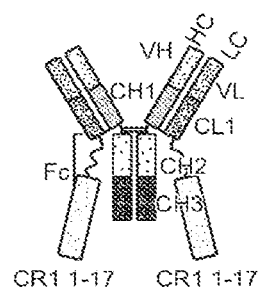
Figure 31E:
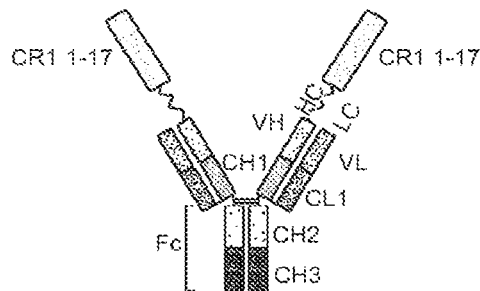
Figure 31F:
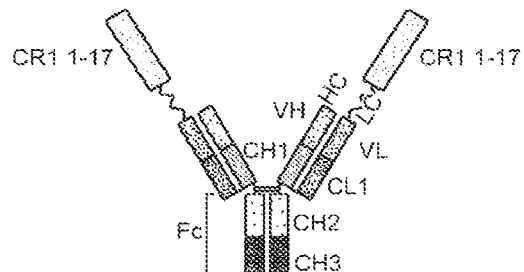

Certain examples of the fusion protein constructs can include, but are not limited to constructs illustrated in FIG. 30, comprising complement modulators CR1 (1-10), CR1 (1-17), and fusions with C2 antibodies or antigen binding fragments thereof, such as C2scFv-CR1 1-10, C2scFv-CR1 1-17, C2scFv-Crry, C2 IgG1 heavy chain—CR1 1-10, C2 IgG1 heavy chain—CR1 1-17, C2 IgG1 heavy chain (hole)—CR1 1-10 [pairs with an Fc domain containing a knob], C2 IgG1 heavy chain (hole)—CR1 1-17 [pairs with an Fc domain containing a knob], C2 IgG1 heavy chain (knob) [pairs with an Fc domain containing a hole)], C2 IgG1 Fab heavy chain—Crry, C2 IgG1 Fab heavy chain—CR1 1-10, C2 IgG1 Fab heavy chain—CR1 1-17, CR1 1-10-IgG1 Fc (hole) [pairs with an Fc domain containing a knob], CR1 1-17-IgG1 Fc (hole) [pairs with an Fc domain containing a knob], CR1 1-10—C2 IgG1 heavy chain (hole) [pairs with a construct comprising an Fc domain with a knob], CR1 1-17—C2 IgG1 heavy chain (hole) [pairs with a construct comprising an Fc domain with a knob], CR1 1-10—C2 IgG1 Fab heavy chain, CR1 1-17—C2 IgG1 Fab heavy chain, CR1 1-10—C2 kappa light chain, CR1 1-17—C2 kappa light chain; constructs illustrated in FIG. 31, comprising complement modulator factor H and fusions with anti-C3d antibody (3d29) or antigen binding fragments thereof, such as, 3d29 kappa light chain, 3d29 Fab heavy chain murine IgG1, 3d29 Fab heavy chain murine IgG1—Crry, 3d29 Fab heavy chain murine IgG1—CR1 1-10, 3d29 Fab heavy chain murine IgG1—CR1 1-17, 3d29 heavy chain murine IgG1—fH 1-5, 3d29 heavy chain murine IgG1 (knob), 3d29 heavy chain murine IgG1 (hole)—fH 1-5, 3d29 heavy chain murine IgG1—fH 1-5; constructs illustrated in FIG. 32, comprising fusions with anti-C3d antibody (3d8b) or antigen binding fragments thereof, 3d8b Fab heavy chain murine IgG1—Crry, 3d8b Fab heavy chain murine IgG1—CR1 1-10, 3d8b Fab heavy chain murine IgG1—fH 1-5, 3d8b heavy chain murine IgG1, 3d8b kappa light chain—CR1 1-10, 3d8b kappa light chain—CR1 1-17, 3d8b heavy chain murine IgG1 (knob) paired with 3d8b heavy chain murine IgG1 (hole), 3d8b heavy chain murine IgG1—CR1 1-10, 3d8b heavy chain murine IgG1—CR1 1-17, 3d8b heavy chain murine IgG1 (hole)—fH 1-5 paired with 3d8b heavy chain murine IgG1 (knob), 3d8b heavy chain murine IgG1—fH 1-5, CR1 1-10-3d8b heavy chain murine IgG1, CR1 1-10-3d8b kappa light chain, CR1 1-17 3d8b kappa light chain, 3d29 heavy chain murine IgG1—CR1 1-10, 3d29 heavy chain murine IgG1—CR1 1-10 +His tag, 3d29 heavy chain murine IgG1 (knob)—CR1 1-10 +His tag, 3d29 heavy chain murine IgG1 (hole), 3d29 heavy chain murine IgG1—CR1 1-17, 3d29 heavy chain murine IgG1—CR1 1-17-1-his tag, 3d29 heavy chain murine IgG1 (knob)—CR1 1-17 +His tag, 3d29 heavy chain murine IgG1 (hole), fH 1-5-3d8b heavy chain murine IgG1, 3d8b kappa light chain—fH 1-5,and fH 1-5 3d8b kappa light chain; CR1 1-10-murine IgG1 Fc (knob); 3d8b heavy chain murine IgG1 (hole); 3d8b kappa light chain (murine); fH 1-5—murine IgG1 Fc (knob); 3d8b Fab heavy chain murine IgG1—CR1 1-17; 3d8b heavy chain murine IgG1 (hole)—CR1 1-17; 3d8b heavy chain murine IgG1 (knob); 3d8b heavy chain murine IgG1—CR1 1-17; 3d8b heavy chain murine IgG1; 3d8b kappa light chain—CR1 1-17; CR1 1-17 3d8b heavy chain murine IgG1; CR1 1-17-3d8b kappa light chain. Amino acid sequences for exemplary constructs are provided in SEQ ID Nos. 103-149, and FIGS. 30-35 provide exemplary illustrations of the same.

Table 1 provides a list of exemplary constructs comprising anti-C3d antibodies or antigen binding fragments thereof; and fusion protein constructs comprising anti-C3d antibodies or antigen binding fragments thereof and complement modulators or biologically active fragments thereof. Sequences are provided for heavy chain and light chain of the antibodies, including sequences of complement modulator polypeptides or biologically active fragments thereof that are conjugated to the anti-C3d antibodies (e.g., one or more complement modulators conjugated to heavy chains of an exemplary anti-C3d antibody, C-terminally or N-terminally; one or more complement modulators conjugated to light chains of an exemplary anti-C3d antibody, C-terminally or N-terminally; one or more complement modulators conjugated to the hinge region of an anti-C3d antibody). The fusion protein constructs comprising the anti-C3d antibodies, in some instances, comprise an anti-C3d antibody comprising two heavy chains and two light chains; in some instances comprise an anti-C3d Fab fragment, in some instances comprise an anti-C3d scFv. In some instances, the constructs comprise two molecules of the first polypeptide (two heavy chains identified in the table as HC1 or HC1+ complement modulator and HC2 or HC2+complement modulator) and two molecules of the second polypeptide (two light chains identified in the table as LC1 or LC1+ complement modulator and LC2 or LC2+complement modulator).

TABLE 1

Exemplary protein constructs

| Exemplary Fusion Construct No. | First polypeptide (heavy chain sequence 1 (HC1))/(HC1 + complement modulator) | Second polypeptide (light chain sequence (LC1))/(LC1 + complement modulator) | First polypeptide (heavy chain sequence (HC2))/(HC2 + complement modulator) | Second polypeptide (light chain sequence (LC2))/(LC2 + complement modulator) |
|---|---|---|---|---|
| Exemplary Fusion Construct 35 | SEQ ID No. 60 | SEQ ID No. 59 | | |
| Exemplary Fusion Construct 36 | SEQ ID No. 61 | SEQ ID No. 59 | | |
| Exemplary Fusion Construct 37 | SEQ ID No. 58 conjugated to SEQ ID No. 72 | SEQ ID No. 59 | | |
| Exemplary Fusion Construct 38 | SEQ ID No. 65 | SEQ ID No. 59 | SEQ ID No. 64 | SEQ ID No. 59 |
| Exemplary Fusion Construct 39 | SEQ ID No. 65 | SEQ ID No. 59 | SEQ ID No. 65 | SEQ ID No. 59 |
| Exemplary Fusion Construct 40 | SEQ ID No. 243 conjugated to SEQ ID No. 72 | SEQ ID No. 59 | SEQ ID No. 64 | SEQ ID No. 59 |
| Exemplary Fusion Construct 41 | SEQ ID No. 64 conjugated to SEQ ID No. 72 | SEQ ID No. 59 | SEQ ID No. 64 conjugated to SEQ ID No. 72 | SEQ ID No. 59 |
| Exemplary Fusion Construct 42 | SEQ ID No. 67 | SEQ ID No. 68 | | |
| Exemplary Fusion Construct 43 | SEQ ID No. 70 | SEQ ID No. 68 | | |
| Exemplary Fusion Construct 44 | SEQ ID No. 71 | SEQ ID No. 68 | | |
| Exemplary Fusion Construct 45 | SEQ ID No. 75 | SEQ ID No. 68 | SEQ ID No. 74 | SEQ ID No. 68 |
| Exemplary Fusion Construct 46 | SEQ ID No. 76 | SEQ ID No. 68 | SEQ ID No. 76 | SEQ ID No. 68 |
| Exemplary Fusion Construct 47 | SEQ ID No. 82 | SEQ ID No. 68 | SEQ ID No. 74 | SEQ ID No. 68 |
| Exemplary Fusion Construct 48 | SEQ ID No. 71 | SEQ ID No. 68 | SEQ ID No. 71 | SEQ ID No. 68 |
| Exemplary Fusion Construct 50 | SEQ ID No. 78 | SEQ ID No. 68 | SEQ ID No. 78 | SEQ ID No. 68 |
| Exemplary Fusion Construct 51 | SEQ ID No. 73 | SEQ ID No. 79 | SEQ ID No. 73 | SEQ ID No. 79 |
| Exemplary Fusion Construct 52 | SEQ ID No. 73 | SEQ ID No. 77 | SEQ ID No. 73 | SEQ ID No. 77 |
| Exemplary Fusion Construct 59 | SEQ ID No. 85 | SEQ ID No. 68 | SEQ ID No. 85 | SEQ ID No. 68 |
| Exemplary Fusion Construct 60 | SEQ ID No. 73 | SEQ ID No. 84 | SEQ ID No. 73 | SEQ ID No. 84 |
| Exemplary Fusion Construct 61 | SEQ ID No. 73 | SEQ ID No. 86 | SEQ ID No. 73 | SEQ ID No. 86 |
| Exemplary Fusion Construct 62 | SEQ ID No. 132 | SEQ ID No. 68 | | |
| Exemplary Fusion Construct 63 | SEQ ID No. 133 | SEQ ID No. 68 | | |
| Exemplary Fusion Construct 64 | SEQ ID No. 134 | SEQ ID No. 68 | SEQ ID No. 134 | SEQ ID No. 68 |
| Exemplary Fusion Construct 65 | SEQ ID No. 73 | SEQ ID No.135 | SEQ ID No. 73 | SEQ ID No. 135 |
| Exemplary Fusion Construct 68 | SEQ ID No. 80 | SEQ ID No. 68 | SEQ ID No. 81 | SEQ ID No. 68 |
| Exemplary Fusion Construct 69 | SEQ ID No. 87 | SEQ ID No. 68 | SEQ ID No. 88 | SEQ ID No. 68 |
| Exemplary Fusion Construct 94 | SEQ ID No. 282 conjugated to SEQ ID No. 42, via SEQ ID No. 138 (linker) | SEQ ID No. 279 | SEQ ID No. 282 conjugated to SEQ ID No. 42, via SEQ ID No. 138 (linker) | SEQ ID No. 279 |
| Exemplary Fusion Construct 95 | SEQ ID No. 282 | SEQ ID No. 279 conjugated to SEQ ID No. 41 via SEQ ID No. 138 (linker) | SEQ ID No. 282 | SEQ ID No. 279 conjugated to SEQ ID No. 41 via SEQ ID No. 138 (linker) |
| Exemplary Fusion Construct 96 | SEQ ID No. 282 conjugated to SEQ ID No. 41, via SEQ ID No. 138 (linker) | SEQ ID No. 279 | SEQ ID No. 282 conjugated to SEQ ID No. 41, via SEQ ID No. 138 (linker) | SEQ ID No. 279 |

TABLE 1-continued

Exemplary protein constructs

| Exemplary Fusion Construct No. | First polypeptide (heavy chain sequence 1 (HC1))/(HC1 + complement modulator) | Second polypeptide (light chain sequence (LC1))/(LC1 + complement modulator) | First polypeptide (heavy chain sequence (HC2))/(HC2 + complement modulator) | Second polypeptide (light chain sequence (LC2))/LC2 + complement modulator) |
|---|---|---|---|---|
| Exemplary Fusion Construct 97 | SEQ ID No. 282 conjugated to SEQ ID No. 72, via SEQ ID No. 138 (linker) | SEQ ID No. 279 | SEQ ID No. 282 conjugated to SEQ ID No. 72, via SEQ ID No. 138 (linker) | SEQ ID No. 279 |
| Exemplary Fusion Construct 99 | SEQ ID No. 284 conjugated to SEQ ID No. 41, via SEQ ID No. 138 (linker) | SEQ ID No. 279 | SEQ ID No. 284 conjugated to SEQ ID No. 41, via SEQ ID No. 138 (linker) | SEQ ID No. 279 |
| Exemplary Fusion Construct 100 | SEQ ID No. 284 conjugated to SEQ ID No. 42, via SEQ ID No. 138 (linker) | SEQ ID No. 279 | SEQ ID No. 284 conjugated to SEQ ID No. 42, via SEQ ID No. 138 (linker) | SEQ ID No. 279 |
| Exemplary Fusion Construct 104 | SEQ ID No. 284 conjugated to SEQ ID No. 72, via SEQ ID No. 138 (linker) | SEQ ID No. 279 | SEQ ID No. 284 | SEQ ID No. 279 |
| Exemplary Fusion Construct 106 | SEQ ID No. 284 conjugated to SEQ ID No. 41, via SEQ ID No. 138 (linker) | SEQ ID No. 279 conjugated to SEQ ID No. 41, via SEQ ID No. 138 (linker) | SEQ ID No. 284 conjugated to SEQ ID No. 72, via SEQ ID No. 138 (linker) | SEQ ID No. 279 conjugated to SEQ ID No. 41, via SEQ ID No. 138 (linker) |
| Exemplary Fusion Construct 107 | SEQ ID No. 284 conjugated to SEQ ID No. 42, via SEQ ID No. 138 (linker) | SEQ ID No. 279 conjugated to SEQ ID No. 42, via SEQ ID No. 138 (linker) | SEQ ID No. 284 conjugated to SEQ ID No. 42, via SEQ ID No. 138 (linker) | SEQ ID No. 279 conjugated to SEQ ID No. 42, via SEQ ID No. 138 (linker) |
| Exemplary Fusion Construct 116 | SEQ ID No. 69 | SEQ ID No. 68 | SEQ ID No. 69 | SEQ ID No. 68 |
| Exemplary Fusion Construct 118 | SEQ ID No. 73 conjugated to SEQ ID No. 291, via SEQ ID No. 138 (linker) | SEQ ID No. 68 | SEQ ID No. 73 conjugated to SEQ ID No. 291, via SEQ ID No. 138 (linker) | SEQ ID No. 68 |
| Exemplary Fusion Construct 129 | SEQ ID No. 286 conjugated to SEQ ID No. 42, via SEQ ID No. 138 (linker) | SEQ ID No. 279 | SEQ ID No. 286 conjugated to SEQ ID No. 42, via SEQ ID No. 138 (linker) | SEQ ID No. 279 |
| Exemplary Fusion Construct 133 | SEQ ID No. 286 conjugated to SEQ ID No. 41, via SEQ ID No. 138 (linker) | SEQ ID No. 279 | SEQ ID No. 286 conjugated to SEQ ID No. 41, via SEQ ID No. 138 (linker) | SEQ ID No. 279 |
| Exemplary Fusion Construct 135 | SEQ ID No. 286 conjugated to SEQ ID No. 72, via SEQ ID No. 138 (linker) | SEQ ID No. 279 | SEQ ID No. 286 conjugated to SEQ ID No. 72, via SEQ ID No. 138 (linker) | SEQ ID No. 279 |
| Exemplary Fusion Construct 138 | SEQ ID No. 282 conjugated to SEQ ID No. 41, via SEQ ID No. 164 (linker) | SEQ ID No. 279 | SEQ ID No. 282 conjugated to SEQ ID No. 41, via SEQ ID No. 164 (linker) | SEQ ID No. 279 |
| Exemplary Fusion Construct 139 | SEQ ID No. 282 conjugated to SEQ ID No. 41, via SEQ ID No. 241 (linker) | SEQ ID No. 279 | SEQ ID No. 282 conjugated to SEQ ID No. 41, via SEQ ID No. 241 (linker) | SEQ ID No. 279 |
| Exemplary Fusion Construct 140 | SEQ ID No. 282 conjugated to SEQ ID No. 42, via SEQ ID No. 164 (linker) | SEQ ID No. 279 | SEQ ID No. 282 conjugated to SEQ ID No. 42, via SEQ ID No. 164 (linker) | SEQ ID No. 279 |

TABLE 1-continued

Exemplary protein constructs

| Exemplary Fusion Construct No. | First polypeptide (heavy chain sequence 1 (HC1))/(HC1 + complement modulator) | Second polypeptide (light chain sequence (LC1))/(LC1 + complement modulator) | First polypeptide (heavy chain sequence (HC2))/(HC2 + complement modulator) | Second polypeptide (light chain sequence (LC2))/LC2 + complement modulator) |
|---|---|---|---|---|
| Exemplary Fusion Construct 141 | SEQ ID No. 282 conjugated to SEQ ID No. 42, via SEQ ID No. 241 (linker) | SEQ ID No. 279 | SEQ ID No. 282 conjugated to SEQ ID No. 42, via SEQ ID No. 241 (linker) | SEQ ID No. 279 |
| Exemplary Fusion Construct 142 | SEQ ID No. 282 conjugated to SEQ ID No. 72, via SEQ ID No. 164 (linker) | SEQ ID No. 279 | SEQ ID No. 282 conjugated to SEQ ID No. 72, via SEQ ID No. 164 (linker) | SEQ ID No. 279 |
| Exemplary Fusion Construct 143 | SEQ ID No. 282 conjugated to SEQ ID No. 72, via SEQ ID No. 241 (linker) | SEQ ID No. 279 | SEQ ID No. 282 conjugated to SEQ ID No. 72, via SEQ ID No. 241 (linker) | SEQ ID No. 279 |
| Exemplary Fusion Construct 146 | SEQ ID No. 285 conjugated to SEQ ID No. 72, via SEQ ID No. 138 (linker) | SEQ ID No. 279 | SEQ ID No. 285 conjugated to SEQ ID No. 72, via SEQ ID No. 138 (linker) | SEQ ID No. 279 |

Variable Domain and CDR Sequences Within Fusion Protein Constructs

In any of the fusion protein constructs described herein, the first polypeptide may comprise (i) three heavy chain CDRs having the amino acid sequences of SEQ ID Nos: 11, 12 and 13, or (ii) three heavy chain CDRs having amino acid sequences that differ by a one, two, or three conservative amino acid substitution within one or more of SEQ ID NOs: 11, 12 or 13; and the second polypeptide may comprise (i) three light chain CDRs having the amino acid sequences of SEQ ID NOs: 14, 15 and 16 or (ii) three light chain CDRs having amino acid sequences that differ by a one, two or three conservative amino acid substitution within one or more of SEQ ID NOs 14, 15 or 16. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 11, 12 and 13, with a single conservative amino acid substitution within heavy chain CDR1, and a second polypeptide comprising the three light chain CDRs of SEQ ID NOs: 14, 15 and 16. In some embodiments, the fusion protein construct has a first polypeptide comprising the three heavy chain CDRs of SEQ ID NOs: 11, 12 and 13, with a single conservative amino acid substitution within heavy chain CDR2, and a second polypeptide comprising the three light chain CDRs of SEQ ID NOs: 14, 15 and 16. In some embodiments, the fusion protein construct has a first polypeptide comprising the three heavy chain CDRs of SEQ ID NOs: 11, 12 and 13, with a single conservative amino acid substitution within heavy chain CDR3, and a second polypeptide comprising the three light chain CDRs of SEQ ID NOs: 14, 15 and 16.

In any of the fusion protein constructs described herein, the first polypeptide may comprise (i) three heavy chain CDRs having the amino acid sequences of SEQ ID Nos: 17, 18 and 19, or (ii) three heavy chain CDRs having amino acid sequences that differ by a one, two, or three conservative amino acid substitution within one or more of SEQ ID NOs: 17, 18 or 19; and the second polypeptide may comprise (i) three light chain CDRs having the amino acid sequences of SEQ ID NOs: 20, 21 and 22 or (ii) three light chain CDRs having amino acid sequences that differ by a one, two or three conservative amino acid substitution within one or more of SEQ ID Nos: 20, 21 or 22. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 17, 18 and 19, with a single conservative amino acid substitution within heavy chain CDR1, and a second polypeptide comprising the three light chain CDRs of SEQ ID NOs: 20, 21 and 22. In some embodiments, the fusion protein construct has a first polypeptide comprising the three heavy chain CDRs of SEQ ID NOs: 17, 18 and 19, with a single conservative amino acid substitution within heavy chain CDR2, and a second polypeptide comprising the three light chain CDRs of SEQ ID NOs: 20, 21 and 22. In some embodiments, the fusion protein construct has a first polypeptide comprising the three heavy chain CDRs of SEQ ID NOs: 17, 18 and 19, with a single conservative amino acid substitution within heavy chain CDR3, and a second polypeptide comprising the three light chain CDRs of SEQ ID NOs: 20, 21 and 22.

In any of the fusion protein constructs described herein, the first polypeptide may comprise (i) three heavy chain CDRs having the amino acid sequences of SEQ ID NOs: 23, 24 and 25, or (ii) three heavy chain CDRs having amino acid sequences that differ by a one, two, or three conservative amino acid substitution within one or more of SEQ ID NOs: 23, 24 and 25; and the second polypeptide may comprise (i) three light chain CDRs having the amino acid sequences of SEQ ID Nos. 26, 27 and 28 or (ii) three light chain CDRs having amino acid sequences that differ by a one, two or three conservative amino acid substitution within one or more of SEQ ID Nos: 26, 27 and 28. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 23, 24 and 25, with a single conservative amino acid substitution within heavy chain CDR1, and a second polypeptide comprising the three light chain CDRs of SEQ ID NOs: 26, 27 and 28. In some embodiments, the fusion protein construct has a first polypeptide comprising the three heavy chain CDRs of SEQ ID NOs: 23, 24 and 25, with a single conservative amino acid substitution within heavy chain. CDR2, and a second polypeptide comprising the three light chain CDRs of SEQ ID NOs: 26, 27 and 28. In some embodiments, the fusion protein construct has a first polypeptide comprising the three heavy chain CDRs of SEQ ID NOs: 23, 24 and 25, with a single conservative amino acid substitution within heavy chain CDR3, and a second polypeptide comprising the three light chain CDRs of SEQ ID NOs: 26, 27 and 28.

In any of the fusion protein constructs described herein, the first polypeptide may comprise (i) three heavy chain CDRs having the amino acid sequences of SEQ ID NOs: 29, 30 and 31, or (ii) three heavy chain CDRs having amino acid sequences that differ by a one, two, or three conservative amino acid substitution within one or more of SEQ ID NOs: 29, 30 and 31; and the second polypeptide may comprise (i) three light chain CDRs having the amino acid sequences of SEQ ID NOs: 32, 33 and 34 or (ii) three light chain CDRs having amino acid sequences that differ by a one, two or three conservative amino acid substitution within one or more of SEQ ID NOs: 32, 33 and 34. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 29, 30 and 31, with a single conservative amino acid substitution within heavy chain CDR1, and a second polypeptide comprising the three light chain CDRs of SEQ ID NOs: 32, 33 and 34. In some embodiments, the fusion protein construct has a first polypeptide comprising the three heavy chain CDRs of SEQ ID NOs: 29, 30 and 31, with a single conservative amino acid substitution within heavy chain CDR2, and a second polypeptide comprising the three light chain CDRs of SEQ ID NOs: 32, 33 and 34. In some embodiments, the fusion protein construct has a first polypeptide comprising the three heavy chain CDRs of SEQ ID NOs: 29, 30 and 31, with a single conservative amino acid substitution within heavy chain CDR3, and a second polypeptide comprising the three light chain CDRs of SEQ ID NOs: 32, 33 and 34.

In any of the fusion protein constructs described herein, the first polypeptide may comprise (i) three heavy chain CDRs having the amino acid sequences of SEQ ID NOs: 29, 259 and 31, or (ii) three heavy chain CDRs having amino acid sequences that differ by a one, two, or three conservative amino acid substitution within one or more of SEQ ID NOs: 29, 259 and 31; and the second polypeptide may comprise (i) three light chain CDRs having the amino acid sequences of SEQ ID NOs: 32, 33 and 34 or (ii) three light chain CDRs having amino acid sequences that differ by a one, two or three conservative amino acid substitution within one or more of SEQ ID NOs: 32, 33 and 34. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 29, 259 and 31, with a single conservative amino acid substitution within heavy chain CDR1, and a second polypeptide comprising the three light chain CDRs of SEQ ID NOs: 32, 33 and 34. In some embodiments, the fusion protein construct has a first polypeptide comprising the three heavy chain CDRs of SEQ ID NOs: 29, 259 and 31, with a single conservative amino acid substitution within heavy chain CDR2, and a second polypeptide comprising the three light chain CDRs of SEQ ID NOs: 32, 33 and 34. In some embodiments, the fusion protein construct has a first polypeptide comprising the three heavy chain CDRs of SEQ ID NOs: 29, 259 and 31, with a single conservative amino acid substitution within heavy chain CDR3, and a second polypeptide comprising the three light chain CDRs of SEQ ID NOs: 32, 33 and 34.

In any of the fusion protein constructs described herein, the first polypeptide may comprise (i) three heavy chain CDRs having the amino acid sequences of SEQ ID NOs: 29, 260 and 31, or (ii) three heavy chain CDRs having amino acid sequences that differ by a one, two, or three conservative amino acid substitution within one or more of SEQ ID NOs: 29, 260 and 31; and the second polypeptide may comprise (i) three light chain CDRs having the amino acid sequences of SEQ ID NOs: 32, 33 and 34 or (ii) three light chain CDRs having amino acid sequences that differ by a one, two or three conservative amino acid substitution within one or more of SEQ ID NOs: 32, 33 and 34. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 29, 260 and 31, with a single conservative amino acid substitution within heavy chain CDR1, and a second polypeptide comprising the three light chain. CDRs of SEQ ID NOs: 32, 33 and 34. In some embodiments, the fusion protein construct has a first polypeptide comprising the three heavy chain CDRs of SEQ ID NOs: 29, 260 and 31, with a single conservative amino acid substitution within heavy chain CDR2, and a second polypeptide comprising the three light chain CDRs of SEQ ID NOs: 32, 33 and 34. In some embodiments, the fusion protein construct has a first polypeptide comprising the three heavy chain CDRs of SEQ ID NOs: 29, 260 and 31, with a single conservative amino acid substitution within heavy chain CDR3, and a second polypeptide comprising the three light chain CDRs of SEQ ID NOs: 32, 33 and 34.

In any of the fusion protein constructs described herein, the first polypeptide may comprise (i) three heavy chain CDRs having the amino acid sequences of SEQ ID NOs: 35, 36 and 37, or (ii) three heavy chain CDRs having amino acid sequences that differ by a one, two, or three conservative amino acid substitution within one or more of SEQ ID NOs: 35, 36 and 37; and the second polypeptide may comprise (i) three light chain CDRs having the amino acid sequences of SEQ ID NOs: 38, 39 and 40 or (ii) three light chain CDRs having amino acid sequences that differ by a one, two or three conservative amino acid substitution within one or more of SEQ ID NOs: 38, 39 and 40. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 35, 36 and 37, with a single conservative amino acid substitution within heavy chain CDR1, and a second polypeptide comprising the three light chain CDRs of SEQ ID NOs: 38, 39 and 40. In some embodiments, the fusion protein construct has a first polypeptide comprising the three heavy chain CDRs of SEQ ID NOs: 35, 36 and 37, with a single conservative amino acid substitution within heavy chain CDR2, and a second polypeptide comprising the three light chain CDRs of SEQ ID NOs: 38, 39 and 40. In some embodiments, the fusion protein construct has a first polypeptide comprising the three heavy chain CDRs of SEQ ID NOs: 35, 36 and 37, with a single conservative amino acid substitution within heavy chain. CDR3, and a second polypeptide comprising the three light chain CDRs of SEQ ID NOs: 38.39 and 40.

In any of the fusion protein constructs described herein, the first polypeptide may comprise (i) three heavy chain CDRs having the amino acid sequences of SEQ ID NOs: 147, 148 and 149, or (ii) three heavy chain CDRs having amino acid sequences that differ by a one, two, or three conservative amino acid substitution within one or more of SEQ ID NOs: 150, 151 and 152; and the second polypeptide may comprise (i) three light chain CDRs having the amino acid sequences of SEQ ID NOs: 147, 148 and 149 or (ii) three light chain CDRs having amino acid sequences that differ by a one, two or three conservative amino acid substitution within one or more of SEQ ID NOs: 150, 151 and 152. In some embodiments, there is a single conservative amino acid substitution within one or more of the CDRs. In other embodiments, there are one, two, three or four additional histidine substitutions within the CDRs.

In some embodiments, the fusion protein construct has a first polypeptide comprising the three heavy chain CDRs of SEQ ID NOs: 147, 148 and 149, with a single conservative amino acid substitution within heavy chain CDR1, and a second polypeptide comprising the three light chain CDRs of SEQ ID NOs: 150, 151 and 152. In some embodiments, the fusion protein construct has a first polypeptide comprising the three heavy chain CDRs of SEQ ID NOs: 147, 148 and 149, with a single conservative amino acid substitution within heavy chain CDR2, and a second polypeptide comprising the three light chain CDRs of SEQ ID NOs: 150, 151 and 152. In some embodiments, the fusion protein construct has a first polypeptide comprising the three heavy chain CDRs of SEQ ID NOs: 147, 148 and 149, with a single conservative amino acid substitution within heavy chain CDR3, and a second polypeptide comprising the three light chain CDRs of SEQ ID NOs: 150, 151 and 152.

In any of the fusion protein constructs described herein, the first polypeptide may comprise (i) three heavy chain CDRs having the amino acid sequences of SEQ ID Nos: 188, 199 and 190, or (ii) three heavy chain CDRs having amino acid sequences that differ by a one, two, or three conservative amino acid substitution within one or more of SEQ ID NOs: 188, 189 and 190; and the second polypeptide may comprise (i) three light chain CDRs having the amino acid sequences of SEQ ID Nos. 191, 192 and 193 or (ii) three light chain CDRs having amino acid sequences that differ by a one, two or three conservative amino acid substitution within one or more of SEQ ID Nos. 191, 192 and 193. In some embodiments, there is a single conservative amino acid substitution within one or more of the CDRs. In other embodiments, there are one, two, three or four additional histidine substitutions (substitution of the original residue with histidine) within the CDRs.

In any of the fusion protein constructs described herein, the first polypeptide may comprise (i) three heavy chain CDRs having the amino acid sequences of SEQ ID NOs: 196, 197 and 198, or (ii) three heavy chain CDRs having amino acid sequences that differ by a one, two, or three conservative amino acid substitution within one or more of SEQ ID NOs: 196, 197 and 198; and the second polypeptide may comprise (i) three light chain CDRs having the amino acid sequences of SEQ ID Nos: 199, 200 and 201 or (ii) three light chain. CDRs having amino acid sequences that differ by a one, two or three conservative amino acid substitution within one or more of SEQ ID NOs: 199, 200 and 201. In some embodiments, there is a single conservative amino acid substitution within one or more of the CDRs. In other embodiments, there are one, two, three or four additional histidine substitutions within the CDRs.

In any of the fusion protein constructs described herein, the first polypeptide may comprise (i) three heavy chain CDRs having the amino acid sequences of SEQ ID NOs: 204 or 343, 205 and 206, or (ii) three heavy chain CDRs having amino acid sequences that differ by a one, two, or three conservative amino acid substitution within one or more of SEQ ID NOs: 204 or 343, 205 and 206; and the second polypeptide may comprise (i) three light chain CDRs having the amino acid sequences of SEQ ID NOs: 207, 208 and 209, or (ii) three light chain CDRs having amino acid sequences that differ by a one, two or three conservative amino acid substitution within one or more of SEQ ID NOs: 207, 208 and 209. In some embodiments, there is a single conservative amino acid substitution within one or more of the CDRs. In other embodiments, there are one, two, three or four additional histidine substitutions within the CDRs.

In any of the fusion protein constructs described herein, the first polypeptide may comprise (i) three heavy chain CDRs having the amino acid sequences of SEQ ID NOs: 212, 213 and 214, or (ii) three heavy chain CDRs having amino acid sequences that differ by a one, two, or three conservative amino acid substitution within one or more of SEQ ID NOs: 212, 213 and 214; and the second polypeptide may comprise (i) three light chain CDRs having the amino acid sequences of SEQ ID NOs: 215, 216 and 217, or (ii) three light chain CDRs having amino acid sequences that differ by a one, two or three conservative amino acid substitution within one or more of SEQ ID Nos. 215, 216 and 217. In some embodiments, there is a single conservative amino acid substitution within one or more of the CDRs. In other embodiments, there are one, two, three or four additional histidine substitutions within the CDRs.

In any of the fusion protein constructs described herein, the first polypeptide may comprise (i) three heavy chain CDRs having the amino acid sequences of SEQ ID NO: 220, 221 and 222, or (ii) three heavy chain CDRs having amino acid sequences that differ by a one, two, or three conservative amino acid substitution within one or more of SEQ ID NOs: 220, 221 and 222; and the second polypeptide may comprise (i) three light chain CDRs having the amino acid sequences of SEQ ID NOs: 223, 224 and 225 or (ii) three light chain CDRs having amino acid sequences that differ by a one, two or three conservative amino acid substitution within one or more of SEQ ID NOs: 223, 224 and 225. In some embodiments, there is a single conservative amino acid substitution within one or more of the CDRs. In other embodiments, there are one, two, three or four additional histidine substitutions within the CDRs.

In any of the fusion protein constructs described herein, the first polypeptide may comprise (i) three heavy chain CDRs having the amino acid sequences of SEQ ID NOs: 228, 229, and 230, or (ii) three heavy chain CDRs having amino acid sequences that differ by a one, two, or three conservative amino acid substitution within one or more of SEQ ID NOs: 228, 229, and 230; and the second polypeptide may comprise (i) three light chain CDRs having the amino acid sequences of SEQ ID NOs: 231, 232, and 233 or (ii) three light chain CDRs having amino acid sequences that differ by a one, two or three conservative amino acid substitution within one or more of SEQ ID NOs: 231, 232, and 233. In some embodiments, there is a single conservative amino acid substitution within one or more of the CDRs. In other embodiments, there are one, two, three or four additional histidine substitutions within the CDRs.

In any of the fusion protein constructs described herein, the first polypeptide may comprise (i) a heavy chain variable region comprising the amino acid sequence of at least one of SEQ ID Nos: 194, 202, 210, 218, 226, 234, 246, 247, 248, 249, 250, 251, 252, 253, 254, 255, 261, 262, 263, 264, 265, 270, 271, 272, 273, and 274; and (ii) a light chain variable region comprising the amino acid sequence of at least one of SEQ ID Nos: 195, 203, 211, 219, 227, 235, 256, 257, 258, 266, 267, 268, 269, 275, 276, 277, and 278, or (i) a heavy chain variable region comprising an amino acid sequence that differs by a one or more conservative amino acid substitution within at least one of SEQ ID Nos: 194, 202, 210, 218, 226, 234, 246, 247, 248, 249, 250, 251, 252, 253, 254, 255, 261, 262, 263, 264, 265, 270, 271, 272, 273, and 274; and (ii) a light chain variable region comprising an amino acid sequence that differs by one or more conservative amino acid substitution within at least one of SEQ ID Nos: 195, 203, 211, 219, 227, 235, 256, 257, 258, 266, 267, 268, 269, 275, 276, 277, and 278.

In any of the fusion protein constructs described herein, the first polypeptide may comprise (i) a humanized heavy chain variable region comprising the amino acid sequence of at least one of SEQ ID Nos: 246, 247, 248, 249, 250, 251, 252, 253, 254, 255, 261, 262, 263, 264, 265, 270, 271, 272, 273, and 274; and (ii) a humanized light chain variable region comprising the amino acid sequence of at least one of SEQ ID Nos: 256, 257, 258, 266, 267, 268, 269, 275, 276, 277, and 278, or (i) a humanized heavy chain variable region comprising an amino acid sequence that differs by a one or more conservative amino acid substitution within at least one of SEQ ID Nos: 246, 247, 248, 249, 250, 251, 252, 253, 254, 255, 261, 262, 263, 264, 265, 270, 271, 272, 273, and 274; and (ii) a humanized light chain variable region comprising an amino acid sequence that differs by one or more conservative amino acid substitution within at least one of SEQ ID Nos: 256, 257, 258, 266, 267, 268, 269, 275, 276, 277, and 278.

In any of the fusion protein constructs described herein, the first polypeptide may comprise (i) a humanized heavy chain variable region comprising the amino acid sequence of at least one of SEQ ID Nos: 246, 247, 248, 249, 250, 251, 252, 253, 254, and 255; and (ii) a light chain variable region comprising the amino acid sequence of at least one of SEQ ID Nos: 256, 257, and 258, or (i) a humanized heavy chain variable region comprising an amino acid sequence that differs by a one or more conservative amino acid substitution within at least one of SEQ ID Nos: 246, 247, 248, 249, 250, 251, 252, 253, 254, and 255; and (ii) a humanized light chain variable region comprising an amino acid sequence that differs by one or more conservative amino acid substitution within at least one of SEQ ID Nos: 256, 257, and 258.

In any of the fusion protein constructs described herein, the first polypeptide may comprise (i) a humanized heavy chain variable region comprising the amino acid sequence of SEQ ID No: 254; and (ii) a light chain variable region comprising the amino acid sequence of SEQ ID No: 258, or (i) a humanized heavy chain variable region comprising an amino acid sequence that differs by a one or more conservative amino acid substitution within SEQ ID No: 254; and (ii) a humanized light chain variable region comprising an amino acid sequence that differs by one or more conservative amino acid substitution within SEQ ID No: 258.

In any of the fusion protein constructs described herein, the first polypeptide may comprise (i) a humanized heavy chain variable region comprising the amino acid sequence of SEQ ID No: 251; and (ii) a light chain variable region comprising the amino acid sequence of SEQ ID No: 258, or (i) a humanized heavy chain variable region comprising an amino acid sequence that differs by a one or more conservative amino acid substitution within SEQ ID No: 251; and (ii) a humanized light chain variable region comprising an amino acid sequence that differs by one or more conservative amino acid substitution within SEQ ID No: 258.

In any of the fusion protein constructs described herein, the first polypeptide may comprise (i) a humanized heavy chain variable region comprising the amino acid sequence of at least one of SEQ ID Nos: 261, 262, 263, 264, and 265; and (ii) a light chain variable region comprising the amino acid sequence of at least one of SEQ ID Nos: 266, 267, 268, and 269, or (i) a humanized heavy chain variable region comprising an amino acid sequence that differs by a one or more conservative amino acid substitution within at least one of SEQ ID Nos: 261, 262, 263, 264, and 265; and (ii) a humanized light chain variable region comprising an amino acid sequence that differs by one or more conservative amino acid substitution within at least one of SEQ ID Nos: 266, 267, 268, and 269.

In any of the fusion protein constructs described herein, the first polypeptide may comprise (i) a humanized heavy chain variable region comprising the amino acid sequence of SEQ ID No: 264; and (ii) a light chain variable region comprising the amino acid sequence of SEQ ID No: 269, or (i) a humanized heavy chain variable region comprising an amino acid sequence that differs by a one or more conservative amino acid substitution within SEQ ID No: 264; and (ii) a humanized light chain variable region comprising an amino acid sequence that differs by one or more conservative amino acid substitution within SEQ ID No: 269.

In any of the fusion protein constructs described herein, the first polypeptide may comprise (i) a humanized heavy chain variable region comprising the amino acid sequence of SEQ ID No: 264; and (ii) a light chain variable region comprising the amino acid sequence of SEQ ID No: 268, or (i) a humanized heavy chain variable region comprising an amino acid sequence that differs by a one or more conservative amino acid substitution within SEQ ID No: 264; and (ii) a humanized light chain variable region comprising an amino acid sequence that differs by one or more conservative amino acid substitution within SEQ ID No: 268.

In any of the fusion protein constructs described herein, the first polypeptide may comprise (i) a humanized heavy chain variable region comprising the amino acid sequence of SEQ ID No: 263; and (ii) a light chain variable region comprising the amino acid sequence of SEQ ID No: 269, or (i) a humanized heavy chain variable region comprising an amino acid sequence that differs by a one or more conservative amino acid substitution within SEQ ID No: 263; and (ii) a humanized light chain variable region comprising an amino acid sequence that differs by one or more conservative amino acid substitution within SEQ ID No: 269.

In any of the fusion protein constructs described herein, the first polypeptide may comprise (i) a humanized heavy chain sequence comprising the amino acid sequence of at least one of SEQ ID Nos: 280, 281, 282, 237, 283, 284, 285, and 286; and (ii) a light chain sequence comprising the amino acid sequence of SEQ ID No. 279, or (i) a humanized heavy chain sequence comprising an amino acid sequence that differs by a one or more conservative amino acid substitution within at least one of SEQ ID Nos: 280, 281, 282, 237, 283, 284, 285, and 286; and (ii) a humanized light chain sequence comprising an amino acid sequence that differs by one or more conservative amino acid substitution within SEQ ID No, 279.

A fusion protein construct described herein comprises, in some embodiments, a humanized heavy chain sequence comprising the amino acid sequence of at least one of SEQ ID Nos: 280, 281, 282, 283, 284, 285, and 286 or a humanized heavy chain sequence comprising an amino acid sequence that differs by a one or more conservative amino acid substitution within at least one of SEQ ID Nos: 280, 281, 282, 237, 283, 284, 285, and 286. A fusion protein construct described herein comprises, in some embodiments, a humanized light chain sequence comprising the amino acid sequence of SEQ ID No. 279, or a humanized light chain sequence comprising an amino acid sequence that differs by one or more conservative amino acid substitution within SEQ ID No. 279.

In any of the fusion protein constructs described herein, the first polypeptide may comprise (i) a murine heavy chain sequence comprising the amino acid sequence of at least one of SEQ ID Nos. 73, 288, 244, 290, and 342; and (ii) a murine light chain sequence comprising the amino acid sequence of at least one of SEQ ID Nos. 68, 287, 59, and 289 or (i) a murine heavy chain sequence comprising an amino acid sequence that differs by a one or more conservative amino acid substitution within at least one of SEQ ID Nos. 73, 288, 244, 290, and 342; and (ii) a murine light chain sequence comprising an amino acid sequence that differs by one or more conservative amino acid substitution within at least one of SEQ ID Nos. 68, 287, 59, and 289.

A fusion protein construct described herein comprises, in some embodiments, a murine heavy chain sequence comprising the amino acid sequence of at least one of SEQ ID Nos. 73, 288, 244, 290, and 342or a murine heavy chain sequence comprising an amino acid sequence that differs by a one or more conservative amino acid substitution within at least one of SEQ ID Nos. 73, 288, 244, 290, and 342. A fusion protein construct described herein comprises, in some embodiments, a murine light chain sequence comprising the amino acid sequence of at least one of SEQ ID Nos. 68, 287, 59, and 289 or a murine light chain sequence comprising an amino acid sequence that differs by a one or more conservative amino acid substitution within at least one of SEQ ID Nos. 68, 287, 59, and 289.

A conservative amino acid substitution is a substitution that changes a given amino acid to a different amino acid with similar biochemical properties (e.g., charge, hydrophobicity, size). For example, any one of the amino acids within the following categories are considered conservative amino acid substitutions: Polar (hydrophilic) neutral amino acids: serine (Ser), threonine (Thr), cysteine (Cys), histidine (His), asparagine (Asn), glutamine (Gln), and tyrosine (Tyr); Polar negatively charged amino acids: aspartic acid (Asp), glutamic acid (Glu); Polar positively charged amino acids: histidine (His), lysine (Lys), arginine (Arg); Hydrophobic amino acids: glycine (Gly), alanine (Ala), valine (Val), leucine (Leu), isoleucine (Ile), praline (Pro), phenylalanine (Phe), methionine (Met), and tryptophan (Trp); Hydrophobic amino acids with aliphatic side chains: alanine (Ala), valine (Val), leucine (Leu), isoleucine (Ile); Hydrophobic amino acids with aromatic side chains: phenylalanine (Phe), tryptophan (Trp); Amino acids that are small in size: alanine (Ala), cysteine (Cys), glycine (Gly), proline (Pro), serine (Ser) and threonine (Thr).

Conjugation of Targeting Moiety and Complement Modulator

The linkage between the targeting moiety and the complement modulator can comprise a conjugation via: (1) a direct fusion of the two protein sequences; or (2) a fusion with an intervening linker/linker sequence/spacer/tethering sequence. The terms "linker," "linker sequence," "spacer," or "tethering sequence," as used herein can mean a molecule or group of molecules (such as a monomer or polymer) that connects two molecules and often serves to place the two molecules in a preferred configuration. A number of strategies may be used to covalently link molecules together. These include but are not limited to polypeptide linkages between N- and C-termini of proteins or protein domains, linkage via disulfide bonds, and linkage via chemical cross-linking reagents. In one aspect, the linker is a peptide bond, generated by recombinant techniques or peptide synthesis.

In some examples, the complement modulator and the targeting moiety may be conjugated via a linker peptide, e.g., a linker peptide that may directly link a targeting moiety and a complement modulator. The linker peptide may contain amino acid residues that provide flexibility. Thus, the linker peptide may include the following amino acid residues: glycine, serine, alanine, or threonine. The linker peptide should have a length that is adequate to link two molecules in such a way that they assume the correct confirmation relative to one another so that they retain the desired activity. Suitable lengths for this purpose may include at least one to about 100 amino acid residues or more. The linker can be from about 1 to 30 amino acids in length. The linker can be from about 1 to 20 amino acids in length. Linker peptides can be included as spacers between two protein moieties. Linker peptides can promote proper protein folding, stability, expression, and bioactivity of the component protein moieties. Long flexible linker peptides can be composed of glycine, serine, or threonine, with multiple glycine residues providing a highly flexible confirmation. Serine or threonine residues provide polar surface area to limit hydrophobic interaction within the peptide or with the component fusion protein moieties. The amino acid residues selected for inclusion in the linker peptide can exhibit properties that do not interfere significantly with the activity of the polypeptide. Thus, the linker peptide may not exhibit a charge that would be inconsistent with the activity of the polypeptide, or interfere with internal folding, or form bonds or other interactions with amino acid residues in the targeting moiety or the complement modulator that would seriously impede the binding of the moieties to their targets. Non-limiting examples of sequences which may serve as the linker can include short peptides of about 2 to about 15 amino acids in length. Among the peptide sequences that can be used as linkers in this disclosure are $(Gly\text{-}Ser)_n$, where n=0,1, 2, 3, 4, 5, 6, 7, or 8 (SEQ ID NO: 292); $(GlyGlyGlySer)_n$, where n=1, 2, 3, or 4 (SEQ ID NO: 293); $(GlySerSerGly)_n$, where n=1, 2, 3, or 4 (SEQ ID NO: 294). In some fusion protein constructs, the linker sequence is (GlyGlyGlyGlyGlySerGlyGlyGlyGlySer) (SEQ ID NO: 138). In some cases, glycine-alanine polymers, alanine-serine polymers, and other flexible linkers such as a tether blocker for the shaker potassium channel, comprising, a panel of quaternary ammoniums (QA) linked to maleimides with varying length poly-glycine tethers, see, e.g., T. J. Morin and W. R. Kobertz Tethering Chemistry and K+ Channels J. Biol. Chem. 283(37): 25105-25109 (2008), and a large variety of other flexible linkers can be used. Glycine-serine polymers can be used since both amino acids are relatively unstructured, and therefore may be able to serve as a neutral tether between components. Secondly, serine is hydrophilic and therefore able to solubilize what could be a globular glycine chain. In some cases, the linker can comprise a sequence as set forth in any one of SEQ ID NOs: 171-193, where, in some examples, n can be at least 4; in some examples, n can be between 1 and 8, between 1 and 5. For instance, in SEQ ID NO: 161, n can be at least 4; in SEQ ID NO: 164, n=1-8; in. SEQ ID NO: 165, n=1-5; in SEQ ID NO: 166, n=1-5. In SEQ ID NO: 168, X can be A (alanine), K (lysine), or E (glutamic acid), and n=5-17. In some cases, n in SEQ ID Nos: 161, 164, 165, 166, 168, 170, 171, 174, and 179 can range from 1 to 17, 1 to 8, 1 to 5, at least 4, or 5 to 17.

Suitable linkers may also be identified by screening databases of known three-dimensional structures for naturally occurring motifs that can bridge the gap between two polypeptide chains, such as linkers derived from naturally occurring multidomain proteins. In some examples, the linker is not immunogenic when administered in a human patient. Thus, linkers may be chosen such that they have low immunogenicity or are thought to have low immunogenicity. For example, a linker may be chosen that exists naturally in a human. In some examples, the linker can have a sequence of the hinge region of an antibody, that is the sequence that links the antibody Fab and Fc regions; alternatively, the linker can have a sequence that comprises part of the hinge region, or a sequence that is substantially similar to the hinge region of an antibody. Another way of obtaining a suitable linker is by optimizing a simple linker, e.g., (Gly4Ser)$_n$ (SEQ ID NO: 295), through random mutagenesis. Alternatively, once a suitable polypeptide linker is defined, additional linker polypeptides can be created to select amino acids that more optimally interact with the domains being linked. Other types of linkers that may be used in the present invention include artificial polypeptide linkers and inteins. In some cases, the complement modulator and the targeting moiety may be conjugated using an enzymatic site-specific conjugation method which involves the use of a mammalian or bacterial transglutaminase enzyme. Microbial transglutaminases (mTGs) are versatile tools in modern research and biotechnology. The availability of large quantities of relatively pure enzymes, ease of use, and lack of regulation by calcium and guanosine-5'-triphosphate (GTP) has propelled mTG to be the main cross-linking enzyme used in both the food industry and biotechnology. Currently, mTGs are used in many applications to attach proteins and peptides to small molecules, polymers, surfaces, DNA, as well as to other proteins. See, e.g., Pavel Strop, Veracity of microbial transglutaminase, Bioconjugate Chem. 25(5): 855-862.

In some examples are provided fusion protein construct comprising targeting moieties comprising an acceptor glutamine in a constant region, which can then be conjugated to a complement protein via a lysine-based linker (e.g., any primary amine chain which is a substrate for TGase, e.g., comprising an alkylamine, oxoamine) wherein the conjugation occurs exclusively on one or more acceptor glutamine residues present in the targeting moiety outside of the antigen combining site (e.g., outside a variable region, in a constant region). Conjugation thus does not occur on a glutamine, e.g., an at least partly surface exposed glutamine, within the variable region. The conjugate may be formed by reacting the targeting moiety and a lysine-based linker in the presence of a TGase. The lysine-based linker may comprise, for example, in addition to a primary amine, e.g., alkylamine, oxoamine, a peptide, polypeptide, any organic molecule, a drug or diagnostic moiety, or may comprise a reactive moiety that can subsequently be reacted with the complement modulator.

In another aspect, disulfide bonds can be designed to link the two molecules. In some cases, linkers are chemical cross-linking agents. For example, a variety of bifunctional protein coupling agents may be used, including but not limited to N-succinimidyl-3-(2-pyridyldithiol) propionate (SPDP), succinimidyl-4-(N-maleimidomethyl) cyclohexane-1-carboxylate, iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2, 4-dinitrobenzene). For example, a ricin immunotoxin can be prepared as described in Vitetta et al., 1971, Science 238: 1098. Chemical linkers may enable chelation of an isotope. For example, Carbon-14-labeled 1-isothiocyanatobenzyl-3-methyldiethylene triaminepentaacetic acid (MX-DTPA) is an exemplary chelating agent for conjugation of radionucleotide to the antibody (see, e.g., WO 94/11026). The linker may be cleavable, facilitating release of the cytotoxic drug in the cell. For example, an acid-labile linker, peptidase-sensitive linker, dimethyl linker or disulfide-containing linker (Chari et al., 1992, Cancer Research 52: 127-131) may be used. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use to link the targeting moieties of the present disclosure to a fusion or conjugate partner, such as a complement modulator to generate a fusion protein construct of this disclosure.

Where the targeting and active moieties are directly joined, a hybrid vector can be made where the DNA encoding the targeting moiety and the complement modulator are themselves directly ligated to each other. Where a linker is used, a hybrid vector can be made where the DNA encoding the targeting moiety is ligated to the DNA encoding one end of the linker moiety; and the DNA encoding the complement modulator is ligated to the other end of the linker moiety. Such ligation may be performed either in series, or as a three-way ligation.

Production, Purification and Characterization Methods

The fusion protein constructs described herein can be produced using a variety of techniques. For example, a nucleic acid encoding a fusion protein construct described herein can be inserted into an expression vector that contains transcriptional and translational regulatory sequences, which include, e.g., promoter sequences, ribosomal binding sites, transcriptional start and stop sequences, translational start and stop sequences, transcription terminator signals, polyadenylation signals, and enhancer or activator sequences. The regulatory sequences include a promoter and transcriptional start and stop sequences. In addition, the expression vector can include more than one replication system such that it can be maintained in two different organisms, for example in mammalian or insect cells for expression and in a prokaryotic host for cloning and amplification.

Several possible vector systems are available for the expression of fusion proteins from nucleic acids in mammalian cells. One class of vectors relies upon the integration of the desired gene sequences into the host cell genome. Cells which have stably integrated DNA can be selected by simultaneously introducing drug resistance genes such as *E. coli* gpt (See Mulligan and Berg Proc. Natl. Acad. Sci. USA 78:2072 (1981)) or Tn5 neo (See Southern and Berg Mol. Appl. Genet. 1:327 (1982)). The selectable marker gene can be either linked to the DNA gene sequences to be expressed or introduced into the same cell by co-transfection (Wigler et al. Cell 16:77 (1979)). A second class of vectors utilizes DNA elements which confer autonomously replicating capabilities to an extrachromosomal plasmid. These vectors can be derived from animal viruses, such as bovine papillomavirus (Sarver et al. Proc. Natl. Acad. Sci. USA, 79:7147 (1982)), polyoma virus (Deans et al. Proc. Natl. Acad. Sci. USA 81:1292(1984)), or SV40 virus (Lusky and Botchan Nature 293:79 (1981)).

The expression vectors can be introduced into cells in a manner suitable for subsequent expression of the nucleic acid. The method of introduction is largely dictated by the targeted cell type, discussed below. Exemplary methods include calcium phosphate precipitation, liposome fusion, lipofectin, electroporation, viral infection, dextran-mediated transfection, polybrene-mediated transfection, protoplast fusion, and direct microinjection.

Appropriate host cells for the expression of the fusion proteins include yeast, bacteria, insect, plant, and, as described above, mammalian cells. Of interest are bacteria such as *E. coli*, fungi such as *Saccharomyces cerevisiae* and *Pichia pastoris*, insect cells such as SF9, mammalian cell lines (e.g., human cell lines), as well as primary cell lines (e.g., primary mammalian cells). In some embodiments, the fusion proteins can be expressed in Chinese hamster ovary (CHO) cells or in a suitable myeloma cell line such as (NS0). Suitable cell lines also include, for example, HEK cells (Human embryonic kidney 293 cells), BHK-21 (baby hamster kidney) cells; 293 (human embryonic kidney) cells; HMEpC (Human Mammary Epithelial cells; 3T3 (mouse embryonic fibroblast) cells.

As will be recognized by the skilled artisan, some complement modulators that may be used in the disclosure occur in nature as secreted proteins in conjunction with a signal or leader peptide, as a pro-peptide, or both, and undergo further intra- or extra-cellular processing. In such cases, the hybrid vectors of this disclosure may include one or more DNA sequences encoding such signal or leader peptides, one or more DNA sequences encoding such pro-peptide sequence, or both, depending upon whether such secretion, processing, or a combination of secretion and processing is desired. Alternatively, the hybrid vectors of the present disclosure may include DNA sequences encoding a different signal or leader peptide, pro-peptide, or both, sequence chosen to optimize the expression and localization of the fusion protein. In most cases, the signal peptide may be omitted, as the targeting moiety will supply sufficient information for targeting of the complement modulator to the desired tissue and cells within a subject's body.

In exemplary production methods, a fusion protein construct described herein can be expressed in, and purified from, transgenic animals (e.g., transgenic mammals). For example, a fusion protein described herein can be produced in transgenic non-human mammals (e.g., rodents, sheep or goats) and isolated from milk as described in, e.g., Houdebine Curr. Opin. Biotechnol. 13(6):625-629 (2002); van Kuik-Romeijn et al. Transgenic Res. 9(2):155-159 (2000); and Pollock et al. J Immunol. Methods 231(1-2):147-157 (1999).

The fusion protein constructs described herein can be produced from cells by culturing a host cell transformed with the expression vector containing nucleic acid encoding the antibodies or antigen binding fragments thereof, under conditions, and for an amount of time, sufficient to allow expression of the proteins. For example, polypeptides expressed in *E. coli* can be refolded from inclusion bodies (see e.g., Hou et al. Cytokine 10:319-30 (1998)). Bacterial expression systems and methods for their use are well known in the art (see Current Protocols in Molecular Biology, Wiley & Sons, and Molecular Cloning—A Laboratory Manual—3rd Ed., Cold Spring Harbor Laboratory Press, New York (2001)). The choice of codons, suitable expression vectors and suitable host cells will vary depending on a number of factors and may be easily optimized as needed. A fusion protein construct described herein can be expressed in mammalian cells or in other expression systems including but not limited to yeast, baculovirus, and in vitro expression systems (see e.g., Kaszubska et al. Protein Expression and Purification 18:213-220 (2000)).

Following expression, the fusion protein constructs can be isolated. The term "purified" or "isolated" as applied to any of the proteins described herein (e.g., a fusion protein constructs described herein) may refer to a polypeptide that has been separated or purified from components (e.g., proteins or other naturally-occurring biological or organic molecules) which naturally accompany it, e.g., other proteins, lipids, and nucleic acid in a prokaryote expressing the proteins. Typically, a polypeptide is purified when it constitutes at least 60 (e.g., at least 65, 70, 75, 80, 85, 90, 92, 95, 97, or 99) %, by weight, of the total protein in a sample. A fusion protein construct described herein can be isolated or purified in a variety of ways depending on what other components are present in the sample. Standard purification methods include electrophoretic, molecular, immunological, and chromatographic techniques, including ion exchange, hydrophobic, affinity, and reverse-phase HPLC chromatography. For example, a fusion protein can be purified using a standard anti-fusion protein antibody affinity column. Ultrafiltration and diafiltration techniques, in conjunction with protein concentration, are also useful. See e.g., Scopes (1994) "Protein Purification, $3^{rd}$ edition," Springer-Verlag, New York City, N.Y. The degree of purification necessary will vary depending on the desired use. In some instances, no purification of the expressed polypeptide thereof will be necessary.

Methods for determining the yield or purity of a purified polypeptide can include, e.g., Bradford assay, UV spectroscopy, Biuret protein assay, Lowry protein assay, amido black protein assay, high pressure liquid chromatography (HPLC), mass spectrometry (MS), and gel electrophoretic methods (e.g., using a protein stain such as Coomassie Blue or colloidal silver stain).

In other exemplary production methods, a fusion protein construct described herein can be synthesized de novo in whole or in part, using chemical methods. For example, the component amino acid sequences can be synthesized by solid phase techniques, cleaved from the resin, and purified by preparative high-performance liquid chromatography followed by chemical linkage to form a desired polypeptide. The composition of the synthetic peptides may be confirmed by amino acid analysis or sequencing.

Once expressed, purified, or after being purified following expression, a fusion protein construct described herein can be assayed for any one of a numbered of desired properties using in vitro or in vivo assays such as any of those described herein. For example, a fusion protein described herein can be assayed for its ability to inhibit C5 convertase as described in, e.g., Heinen et al. Factor H-related protein 1 (CFHR-I) inhibits complement C5 convertase activity and terminal complex formation. Blood 114(12):2439-47 (2009). Endotoxins can be removed from the fusion protein construct preparations using a variety of commercially available reagents including, without limitation, the Proteo-Spin™ Endotoxin Removal Kits (Norgen Biotek Corporation), Detoxi-Gel Endotoxin Removal Gel (Thermo Scientific; Pierce Protein Research Products), Mira-CLEAN® Endotoxin Removal Kit (Minis), or Acrodisc™-Mustang® E membrane (Pall Corporation).

Methods for detecting and/or measuring the amount of endotoxin present in a sample (both before and after purification) can be based on commercial kits that are available. For example, the concentration of endotoxin in a protein sample can be determined using the QCL-1000 Chromogenic kit (BioWhittaker), the limulus amebocyte lysate (LAL)-based kits such as the Pyrotell®, Pyrotell®-T, Pyrochrome®, Chromo-LAL, and CSE kits available from the Associates of Cape Cod Incorporated.

Following expression and purification, the fusion protein constructs described herein can be modified. The modifications can be covalent or non-covalent modifications. Such modifications can be introduced into the fusion proteins by, e.g., reacting targeted amino acid residues of the polypeptide with an organic derivatizing agent that is capable of reacting with selected side chains or terminal residues. Suitable sites for modification can be chosen using any of a variety of criteria including, e.g., structural analysis or amino acid sequence analysis of the fusion proteins described herein.

In some exemplary production methods, a fusion protein construct as described herein can be conjugated to a heterologous moiety. The heterologous moiety can be, e.g., a heterologous polypeptide, a therapeutic agent (e.g., a toxin or a drug), or a detectable label such as, but not limited to, a radioactive label, an enzymatic label, a fluorescent label, or a luminescent label. Suitable heterologous polypeptides can include, e.g., an antigenic tag (e.g., FLAG, polyhistidine, hemagglutinin (HA), glutathione-S-transferase (GST), or maltose-binding protein (MBP)) for use in purifying the antibodies. Heterologous polypeptides can also include polypeptides that are useful as diagnostic or detectable markers, for example, luciferase, green fluorescent protein (GFP), or chloramphenicol acetyl transferase (CAT). Where the heterologous moiety is a polypeptide, the moiety can be incorporated into a fusion protein described herein, resulting in a fusion protein.

Pharmaceutical Formulations

Also provided in this disclosure are pharmaceutical formulations comprising a fusion protein construct as described here. Pharmaceutical formulations of the fusion protein constructs of this disclosure are typically prepared for parenteral administration, i.e., bolus, intravenous, intratumor, subcutaneous injection with a pharmaceutically acceptable parenteral vehicle and in a unit dosage injectable form. A fusion protein construct can be optionally mixed with pharmaceutically acceptable diluents, carriers, excipients or stabilizers (Remington's Pharmaceutical Sciences (1980) 16th edition, Osol, A. Ed.), in the form of a lyophilized formulation or an aqueous solution. Acceptable diluents, carriers, excipients, and stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); non-ionic surfactants such as TWEEN™, PLURONICS™ or polyethylene glycol (PEG), or any combinations thereof.

The fusion protein constructs may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nanoparticles and nanocapsules) or in macroemulsions. Such techniques are disclosed in Remington's Pharmaceutical Sciences 16th edition, Osol, A. Ed. (1980).

Sustained-release preparations may be prepared. Suitable examples of sustained-release preparations include semi permeable matrices of solid hydrophobic polymers containing a fusion protein construct, which matrices are in the form of shaped articles, e.g., films, or microcapsules. Examples of sustained-release matrices include polyesters, hydrogels (for example, poly(2-hydroxyethyl-methacrylate), or poly(vinyl alcohol)), polylactides (U.S. Pat. No. 3,773,919), copolymers of L-glutamic acid and gamma-ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(–)-3-hydroxybutyric acid.

The formulations to be used for in vivo administration are sterile, which can be accomplished by filtration through sterile filtration membranes. The formulations include those suitable for the foregoing administration routes. The formulations may conveniently be presented in unit dosage form and may be prepared by any of the methods usually practiced in preparation of pharmaceutical formulations as unit dosage. Techniques and formulations generally are found in Remington's Pharmaceutical Sciences (Mack Publishing Co., Easton, Pa.). Such methods include the step of bringing into association the active ingredient with the carrier which constitutes one or more accessory ingredients. In general, the formulations are prepared by uniformly and intimately bringing into association the fusion protein constructs with liquid carriers or finely divided solid carriers or both, and then, if necessary, shaking the product.

Aqueous suspensions of this disclosure contain the fusion protein constructs in admixtures with excipients suitable for the manufacture of aqueous suspensions. Such excipients include a suspending agent, such as sodium carboxymethylcellulose, croscarmellose, povidone, methylcellulose, hydroxypropyl methylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethyleneoxycetanol), a condensation product of ethylene oxide with a partial ester derived from a fatty acid and a hexitol anhydride (e.g., polyoxyethylene sorbitan monooleate). The aqueous suspension may also contain one or more preservatives such as ethyl or n-propyl p-hydroxy-benzoate, one or more coloring agents, one or more flavoring agents and one or more sweetening agents, such as sucrose or saccharin.

The pharmaceutical formulations containing the fusion protein constructs may be in the form of a sterile injectable preparation, such as a sterile injectable aqueous or oleaginous suspension. This suspension may be formulated according to methods using those suitable dispersing or wetting agents and suspending agents which have been mentioned above. The sterile injectable preparation may also be a sterile injectable solution or suspension in a non-toxic parenterally acceptable diluent or solvent, such as a solution in 1,3-butane-dial or prepared as a lyophilized powder. Among the acceptable vehicles and solvents that may be employed are water, Ringer's solution and isotonic sodium chloride solution. In addition, sterile fixed oils may conventionally be employed as a solvent or suspending medium. For this purpose, any bland fixed oil may be employed including synthetic mono- or diglycerides. In addition, fatty acids such as oleic acid may likewise be used in the preparation of injectables.

The amount of active ingredient that may be combined with the carrier material to produce a single dosage form will vary depending upon the host treated and the particular mode of administration. For example, an aqueous solution intended for intravenous infusion may contain from about 3 to 500 µg of the active ingredient per milliliter of solution in order that infusion of a suitable volume at a rate of about 30 mL/hour can occur.

Formulations suitable for parenteral administration include aqueous and non-aqueous sterile injection solutions which may contain anti-oxidants, buffers, bacteriostats and solutes which render the formulation isotonic with the blood of the intended recipient; and aqueous and non-aqueous sterile suspensions which may include suspending agents and thickening agents.

Although oral administration of protein therapeutics is disfavored due to hydrolysis or denaturation in the gut, formulations of fusion protein constructs suitable for oral administration may be prepared as discrete units such as capsules, cachets or tablets each containing a predetermined amount of the fusion protein construct.

The formulations may be packaged in unit-dose or multi-dose containers, for example sealed ampoules and vials, and may be stored in a freeze-dried (lyophilized) condition requiring only the addition of the sterile liquid carrier, for example water, for injection immediately prior to use. In some cases, the formulations may be packages in an infusion device, such as an infusion pump, e.g., for controlled delivery. Extemporaneous injection solutions and suspensions are prepared from sterile powders, granules and tablets of the kind previously described. Preferred unit dosage formulations are those containing a daily dose or unit daily sub-dose, as herein above recited, or an appropriate fraction thereof, of the active ingredient.

The disclosure further provides veterinary compositions comprising at least one active ingredient as above defined together with a veterinary carrier therefore. Veterinary carriers are materials useful for the purpose of administering the composition and may be solid, liquid or gaseous materials which are otherwise inert or acceptable in the veterinary art and are compatible with the active ingredient. These veterinary compositions may be administered parenterally, orally or by any other desired route.

Methods of Treating Complement Associated Diseases, Disorders, or Conditions

The fusion protein constructs described herein can be used to treat a variety of complement-associated disorders such as, but not limited to: ischemic-reperfusion injury, rheumatoid arthritis (RA); lupus nephritis; ischemia-reperfusion injury; atypical hemolytic uremic syndrome (aHUS); typical or infectious hemolytic uremic syndrome (tHUS); dense deposit disease (DDD); paroxysmal nocturnal hemoglobinuria (PNH); multiple sclerosis (MS); macular degeneration (e.g., age-related macular degeneration (AMD), geographic atrophy (also known as atrophic age-related macular degeneration or advanced dry AMD); hemolysis, elevated liver enzymes, and low platelets (HELLP) syndrome; sepsis; dermatomyositis; diabetic retinopathy; thrombotic thrombocytopenic purpura (TTP); spontaneous fetal loss; Pauci-immune vasculitis; epidermolysis bullosa; recurrent fetal loss; multiple sclerosis (MS); and traumatic brain injury.

Complement-mediated vascular disorder can also be treated using the fusion protein construct of this disclosure, such as, but not limited to, a cardiovascular disorder, myocarditis, a cerebrovascular disorder, a peripheral (e.g., musculoskeletal) vascular disorder, a renovascular disorder, a mesenteric/enteric vascular disorder, revascularization to transplants and/or replants, vasculitis, Henoch-Schönlein purpura nephritis, systemic lupus erythematosus-associated vasculitis, vasculitis associated with rheumatoid arthritis, immune complex vasculitis, Takayasu's disease, capillary leak syndrome, dilated cardiomyopathy, diabetic angiopathy, thoracic-abdominal aortic aneurysm, Kawasaki's disease (arteritis), venous gas embolus (VGE), and restenosis following stent placement, rotational atherectomy, and percutaneous transluminal coronary angioplasty (PTCA).

The complement-associated disorder can also be myasthenia gravis, cold-agglutinin disease (CAD), paroxysmal cold hemoglobinuria (PCH), idiopathic inflammatory myopathies including dermatomyositis and polymyositis, scleroderma, warm autoimmune hemolytic anemia, Graves' disease, Hashimoto's thyroiditis, type I diabetes, psoriasis, pemphigus, autoimmune hemolytic anemia (AIHA), idiopathic thrombocytopenic purpura (ITP), Goodpasture's syndrome, antiphospholipid syndrome (APS), Degos disease, and catastrophic APS (CAPS).

Ischemia-reperfusion (IR) injury can refer to damage to a tissue caused when the blood supply returns to the tissue after a period of ischemia (restriction in blood supply). The absence of oxygen and nutrients from the blood creates a condition in which the restoration of circulation results in inflammation and oxidative damage, rather than restoration of normal function. Ischemia-reperfusion injury can be associated with traumatic injury, including hemorrhagic shock, as well as many other medical conditions such as stroke or large vessel occlusion (e.g. middle cerebral artery), and is a major medical problem. More particularly, ischemia-reperfusion injury is important in heart attacks, stroke, kidney failure following vascular surgery, post-transplantation injury and chronic rejection, as well as in various types of traumatic injury, where hemorrhage will lead to organ hypoperfusion, and then subsequent reperfusion injury during fluid resuscitation. Ischemia-reperfusion injury, or an injury due to reperfusion and ischemic events, is also observed in a variety of autoimmune and inflammatory diseases. Independently of other factors, ischemia-reperfusion injury may lead to increased mortality. Ischemia-reperfusion injury, as well as hypovolemic shock and subsequent tissue damage, has been shown to be caused by complement and Fc receptor activation and the recruitment and activation of neutrophils and other inflammatory cells. See e.g., S. Rehrig et al., 2001, J. Immunol. 167:5921-5927. It had also been shown that single monoclonal antibodies that react broadly with phospholipids and other extracellular or intracellular antigens such as DNA can cause ischemia-reperfusion injury in mice that lack other antibodies (i.e., B cell-deficient mice).

Renal disease, such as albuminuria, or more broadly, proteinuria, can refer to abnormalities in kidney function that leads to increased levels of protein excretion in the urine. Increased protein levels in the urine is a marker or kidney failure, or kidney damage caused by immune disorders, glomerulonephritis, multiple myeloma, cardiovascular diseases, or kidney trauma. The ratio of albumin and creatinine present in the urine are used to detect potential kidney failure; persistent elevated urine protein levels is indicative of kidney failure.

In some cases, an albumin to creatine ratio is determined. In some embodiments, an albumin to creatine ratio is determined for a subject having a disease (e.g., renal disease). In some embodiments, an albumin to creatine ratio is determined in a biological sample. In some embodiments, the biological sample is urine. In some embodiments, an albumin to creatine ratio determined for a subject having a disease is compared to an albumin to creatine ratio from another subject or the same subject (e.g., another subject with the same disease, or the same subject at different time points, or another subject not having the disease). In some embodiments, the albumin to creatine ratio is determined at some point after the subject is administered with any of the fusion protein construct of this disclosure. In some embodiments, the another subject is administered with a comparable fusion protein construct. In some embodiments, the comparable fusion protein construct does not comprise the antibody or the antigen binding fragment thereof but is otherwise identical to a fusion protein construct of this disclosure. In some embodiments, the albumin to creatinine ratio is determined from a biological sample (e.g., urine sample) from a subject (e.g., a subject having a disease). In some embodiments, the albumin to creatinine ratio from a subject having a disease is at least about 1%, 2%, 3%, 5%, 10%, 15%, 20%, 25%, 30%, 35%, 40%, 45%, 50%, 55%, 60%, 65%, 70%, 75%, 80%, 85%, 90%, 95%, or 99% lower than the albumin to creatinine ratio from a comparable biological sample from the same subject collected at a different time point or from another subject (e.g., another subject administered with a comparable fusion protein construct).

In certain instances, an anti-C3d/C3dg antibody or antigen-binding fragment thereof or a fusion protein construct comprising such antibody or an antigen-binding fragment thereof as the targeting moiety described herein, alone or in combination with a second anti-inflammatory agent, can be used to treat an inflammatory disorder such as, but not limited to, RA (above), inflammatory bowel disease, sepsis (above), septic shock, acute lung injury, disseminated intravascular coagulation (DIC), or Crohn's disease. In some embodiments, the second anti-inflammatory agent can be one selected from. NSAIDs, corticosteroids, methotrexate, hydroxychloroquine, anti-TNF agents such as etanercept and infliximab, a B cell depleting agent such as rituximab, an interleukin-1 antagonist, and a T cell costimulatoiy blocking agent such as abatacept.

In some embodiments, the complement-associated disorder is a complement-associated neurological disorder such as, but not limited to, amyotrophic lateral sclerosis (ALS), brain injury, Alzheimer's disease, and chronic inflammatory demyelinating neuropathy.

Complement-associated disorders also include complement-associated pulmonary disorders such as, but not limited to, asthma, bronchitis, a chronic obstructive pulmonary disease (COPD), an interstitial lung disease, $\alpha$-1 anti-trypsin deficiency, emphysema, bronchiectasis, bronchiolitis obliterans, alveolitis, sarcoidosis, pulmonary fibrosis, and collagen vascular disorders.

The fusion protein constructs of this disclosure can be used to treat one or more indications selected from: Paroxysmal nocturnal hemoglobinuria (PNH), Atypical hemolytic uremic syndrome (aHUS), myasthenia gravis, Antineutrophil cytoplasmic antibody (ANCA)-associated vasculitis (AAV), C3 glomerulonephritis (C3G), cold agglutinin disease (CAD), warm antibody hemolytic anemia, antibody mediated transplant rejection, Neuromyelitis Optica (NMOSD), dense deposit disease, IgA Nephropathy (IgAN), Membranous Nephropathy (MN), thrombotic microangiopathy, hereditary angioedema (HAE), systemic lupus, lupus nephritis, discoid lupus, psoriatic arthritis, psoriasis, atopic dermatitis, alopecia areata, hidradenitis suppurativa, vitiligo, rheumatoid arthritis, periodontal disease, bone disorders (osteoarthritis, fracture, osteomyelitis), Dry macular degeneration, Wet macular degeneration, glaucoma, uveitis, geographic atrophy, heart and lung surgery, cardiac regeneration, lung cancer, neurodegeneration, ALS, MS, traumatic brain injury, spinal cord injury, schizophrenia, major depressive disorder, bipolar disorder, scleroderma, scleroderma renal crisis, cutaneous vasculitis, blistering skin diseases (endemic pemphigus, bullous pemphigoid, Pemphigus erythematosus, pemphigus vulgaris), and drusen-related disease.

While preferred embodiments of this disclosure have been shown and described herein, it will be obvious to those skilled in the art that such embodiments are provided by way of example only. Numerous variations, changes, and substitutions will now occur to those skilled in the art without departing from this disclosure. It should be understood that various alternatives to the embodiments of this disclosure described herein may be employed in practicing the disclosure. It is intended that the claims define the scope of the disclosure and that methods and structures within the scope of these claims and their equivalents be covered thereby.

Certain Definitions

Unless otherwise defined herein, scientific and technical terms used in connection with the present disclosure shall have the meanings that are commonly understood by those of ordinary skill in the art. The meaning and scope of the terms should be clear, however, in the event of any latent ambiguity, definitions provided herein take precedent over any dictionary or extrinsic definition. Further, unless otherwise required by context, singular terms shall include pluralities and plural terms shall include the singular. In this application, the use of "or" means "and/or" unless stated otherwise. Furthermore, the use of the term "including", as well as other forms, such as "includes" and "included", is not limiting.

The term "complement modulator," as used herein, means any molecule that can stimulate or inhibit activity of a complement pathway.

The term "antibody", as used herein, means any antigen-binding molecule comprising at least one complementarity determining region (CDR). The term "antibody" includes immunoglobulin molecules comprising four polypeptide chains, two heavy (H) chains and two light (L) chains inter-connected by disulfide bonds, as well as multimers thereof (e.g., IgM). Each heavy chain comprises a heavy chain variable region (abbreviated herein as HCVR or VH) and a heavy chain constant region. The heavy chain constant region comprises three domains, CH1, CH2 and CH3. Each light chain comprises a light chain variable region (abbreviated herein as LCVR or VL) and a light chain constant region. The light chain constant region comprises one domain (CL1). The VH and VL regions can be further subdivided into regions of hypervariability, termed complementarity determining regions (CDRs), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. In different embodiments of the disclosure, the FRs of the targeting moiety (or antigen-binding portion thereof) may be identical to the human germline sequences or may be naturally or artificially modified. An amino acid consensus sequence may be defined based on a side-by-side analysis of two or more CDRs.

The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. Antigen-binding fragments of an antibody may be derived, e.g., from intact antibody molecules using any suitable standard techniques such as proteolytic digestion or recombinant genetic engineering techniques involving the manipulation and expression of DNA encoding antibody variable and optionally constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained. FR3-CDR3-FR4 peptide.

The term "variable region" or "variable domain" of an antibody, or fragment thereof, as used herein refers to the portions of the light and heavy chains of antibody molecules that include amino acid sequences of complementarity determining regions (CDRs; i.e., CDR1, CDR2, and CDR3), and framework regions (FRs). VH refers to the variable domain of the heavy chain. VL refers to the variable domain of the light chain. According to the methods used in this disclosure, the amino acid positions assigned to CDRs and FRs may be defined according to Kabat et al. (Sequences of Proteins of Immunological Interest (National Institutes of Health, Bethesda, Md., 1987 and 1991)). Amino acid numbering of antibodies or antigen binding fragments is also according to that of Kabat.

The term "complementarity determining regions" or "CDRs" as used herein refers to the complementarity determining region within antibody variable sequences. There are three CDRs in each of the variable regions of the heavy chain and the light chain, which are designated CDR1, CDR2 and CDR3, for each of the variable regions. The term "CDR set" as used herein refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia et al., J. Mol. Biol. 196:901-917 (1987) and Chothia et al., Nature 342:877-883 (1989)) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (FASEB J. 9:133-139 (1995)) and MacCallum (J Mol Biol 262(5):732-45 (1996)). Still other CDR boundary definitions may not strictly follow one of the above systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although preferred embodiments use Kabat or Chothia defined CDRs.

ImMunoGeneTics (MGT) also provides a numbering system for the immunoglobulin variable regions, including the CDRs. See, e.g., M. P. Lefranc et al., Dev. Comp. Immunol. 27: 55-77(2003). The IMGT numbering system is based on an alignment of more than 5,000 sequences, structural data, and characterization of hypervariable loops and allows for easy comparison of the variable and CDR regions for all species. According to the IMGT numbering schema, VH-CDR1 can be at positions 26 to 35, VH-CDR2 can be at positions 51 to 57, VH-CDR3 can be at positions 93 to 102, VL-CDR1 can be at positions 27 to 32, VL-CDR2 can be at positions 50 to 52, and VL-CDR3 can be at positions 89 to 97. in some examples, the antibodies or antigen binding fragment thereof described in this disclosure can include a combination of heavy chain and light chain complementarity determining regions (CDRs) selected from the CDR sequences shown in the Sequence table, where the CDRs shown in the Sequence Table are defined according to the IMGT nomenclature. In some cases, the CDR sequences of the antibodies or antigen binding fragments thereof were analyzed from the cDNA amplified sequences using IMGT software (on the world wide web at http://imgt.org/IMGT_vquest/vquest).

The term "framework regions" (hereinafter FR) as used herein refers to those variable domain residues other than the CDR residues. Each variable domain typically has four FRs identified as FR1, FR2, FR3 and FR4. Common structural features among the variable regions of antibodies, or functional fragments thereof, are well known in the art. The DNA sequence encoding a particular antibody can generally be found following well known methods such as those described in Kabat, et al. 1987 Sequence of Proteins of Immunological Interest, U.S. Department of Health and Human Services, Bethesda, Md., which is incorporated herein as a reference. In addition, a general method for cloning functional variable regions from antibodies can be found in Chaudhary, V. K., et al., 1990 Proc. Natl. Acad. Sci. USA 87:1066, which is incorporated herein as a reference.

The term "Fc region" herein is used to as used herein is meant the polypeptide comprising the constant region of an antibody excluding the first constant region immunoglobulin domain and, in some cases, part of the hinge region. Thus Fc region refers to the last two constant region immunoglobulin domains of IgA, IgD, and IgG, and the last three constant region immunoglobulin domains of IgE and IgM, and the flexible hinge N-terminal to these domains. For IgA and IgM, Fc may include the J chain. For IgG, Fc can comprise immunoglobulin domains CH2 and CH3 and the hinge between CH1 and CH2 (Cgamma 2). Fc may refer to this region in isolation, or this region in the context of an Fc fusion protein. The term Fc region includes, for example, native sequence Fc regions, recombinant Fc regions, and variant Fc regions. Although the boundaries of the Fc region of an antibody heavy chain might vary, the human IgG heavy chain Fc region is often defined to stretch from an amino acid residue at position Cys226, or from Pro230, to the carboxyl-terminus thereof, wherein the numbering is according to the EU index as in Kabat. The C-terminal lysine (residue 447 according to the EU numbering system) of the Fc region may be removed, for example, during production or purification of the antibody, or by recombinantly engineering the nucleic acid encoding a heavy chain of the antibody. Accordingly, the fusion protein constructs described herein may comprise targeting moieties comprising Fc regions where K447 residues are removed, or where no K447 residues are removed, or fusion protein constructs where some of the Fc regions have K447 residues removed while some do not have K447 residues removed.

As used herein, "Fc polypeptide" can refer to a polypeptide that comprises all or part of an Fc region. Fc polypeptides can include antibodies, Fc fusions, isolated Fcs, and Fc fragments. Immunoglobulins may be Fc polypeptides. The term "Fc fusion" as used herein is meant a protein wherein one or more polypeptides is operably linked to Fc. Fc fusion is herein meant to be synonymous with the terms "immunoadhesin," "Ig fusion," "Ig chimera," and "receptor globulin" (or "receptor-globulin") as used, for example, in Chamow et al., 1996, Trends Biotechnol 14:52-60; Ashkenazi et al., 1997, Curr. Opin. Immunol 9:195-200. An Fc fusion can combine the Fc region of an immunoglobulin with a fusion partner, which can be a complement modulator protein, polypeptide or small molecule. In some examples, the role of the non-Fc part of an Fc fusion, i.e., the fusion partner, such as a complement modulator protein, is to mediate target binding, and thus it is functionally analogous to the variable regions of an antibody. Protein fusion partners may include, but are not limited to, the target-binding region of a receptor, an adhesion molecule, a ligand, an enzyme, a cytokine, a chemokine, a complement modulator protein or polypeptide, or some other protein or protein domain. Small molecule fusion partners may include any therapeutic agent that directs the Fc fusion to a therapeutic target. Such targets may be any molecule, e.g., an extracellular receptor that is implicated in disease.

The terms "Fc gamma receptor" or "Fcgamma R" as used herein can mean any member of the family of proteins that bind the IgG antibody Fc region and are substantially encoded by the Fcgamma R genes. In humans this family includes but is not limited to Fcgamma RI (CD64), including isoforms Fcgamma RIa, Fcgamma RIb, and Fcgamma RIc; Fcgamma RII (CD32), including isoforms Fcgamma RIIa (including allotypes H131 and R131), Fcgamma RIIb (including Fcgamma RIIb-1 and Fcgamma RIIb-2), and Fcgamma RIIc; and Fcgamma RIII (CD16), including isoforms Fcgamma RIIIa (including allotypes V158 and F158) and Fcgamma RIIIb (including allotypes Fcgamma RIIIb-NA1 and Fcgamma RIIIb-NA2) (Jefferis et al., 2002, Immunol Lett 82:57-65, incorporated entirely by reference), as well as any undiscovered human Fcgamma Rs or Fcgamma R isoforms or allotypes. An Fcgamma R may be from any organism, including but not limited to humans, mice, rats, rabbits, and monkeys. Mouse Fcgamma Rs include but are not limited to Fcgamma RI (CD64), Fcgamma RII (CD32), Fcgamma RIII (CD16), and Fcgamma RIII-2 (CD16-2), as well as any undiscovered mouse Fcgamma Rs or Fcgamma R isoforms or allotypes.

An "Fc ligand" or "Fc receptor" as used herein can mean a molecule, e.g., a polypeptide, from any organism that binds to the Fc region of an antibody to form an Fc-ligand complex. Fc ligands include but are not limited to Fcgamma Rs, Fcgamma Rs, Fcgamma Rs, FcRn, C1q, C3, mannan-binding lectin, mannose receptor, staphylococcal protein A, streptococcal protein G, and viral Fcgamma R. Fc ligands also include Fc receptor homologs (FcRH), which are a family of Fc receptors that are homologous to the Fcgamma Rs (Davis et al., 2002, Immunological Reviews 190:123-136). Fc ligands may include undiscovered molecules that bind Fc.

The term "humanized antibody" as used herein can refer to an antibody or a variant, derivative, analog or fragment thereof, which can immunospecifically bind to an antigen of interest (e.g., a domain of a mammalian annexin protein, a phospholipid, a complement protein or a fragment thereof, such as C3d), and which comprises a framework (FR) region having substantially the amino acid sequence of a human antibody and a complementary determining region (CDR) having substantially the amino acid sequence of a non-human antibody. Humanized forms of non-human (e.g., murine) antibodies are chimeric immunoglobulins that contain minimal sequences derived from non-human immunoglobulin. In general, a humanized antibody will comprise substantially all of at least one, and typically two, variable domains, in which all or substantially all of the CDR regions correspond to those of a non-human immunoglobulin and all or substantially all of the FR regions are those of a human immunoglobulin sequence. The humanized antibody can also comprise at least a portion of an immunoglobulin constant region (Fc), typically that of a human immunoglobulin consensus sequence. Any suitable methods of antibody humanization can be used. See, e.g., Riechmann et al., 1988, Nature 332:323-7; U.S. Pat. Nos. 5,530,101; 5,585,089; 5,693,761; 5,693,762; and 6,180,370 to Queen et al.; EP239400; PCT publication WO 91/09967; U.S. Pat. No. 5,225,539; EP592106; EP519596; Padlan, 1991, Mol. Immunol., 28:489-498; Studnicka et al., 1994, Prot. Eng. 7:805-814; Roguska et al., 1994, Proc. Natl. Acad. Sci. 91:969-973; and U.S. Pat. No. 5,565,332, all of which are hereby incorporated by reference in their entireties.

The term "monoclonal antibody" as used herein refers to an antibody obtained from a population of substantially homogeneous antibodies, i.e., the individual antibodies comprising the population are identical except for possible mutations, e.g., naturally occurring mutations that may be present in minor amounts. Thus, the modifier "monoclonal" indicates the character of the antibody as not being a mixture of discrete antibodies. In certain embodiments, such a monoclonal antibody typically includes an antibody comprising a polypeptide sequence that binds a target, wherein the target-binding polypeptide sequence was obtained by a process that includes the selection of a single target binding polypeptide sequence from a plurality of polypeptide sequences. For example, the selection process can be the selection of a unique clone from a plurality of clones, such as a pool of hybridoma clones, phage clones, or recombinant DNA clones. In contrast to polyclonal antibody preparations, which typically include different antibodies directed against different determinants (epitopes), each monoclonal antibody of a monoclonal-antibody preparation is directed against a single epitope on an antigen.

The term "chimeric antibody" as used herein refers to antibodies (immunoglobulins) that have a portion of the heavy and/or light chain identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al., Proc. Natl. Acad. Sci. USA 87:6851-6855 (1984)).

The term "epitope" as used herein refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

As used herein, the term "annexin," refers to a large family calcium-dependent membrane binding-proteins that are widely distributed among eukaryotes but are typically absent in prokaryotes and yeasts. The term "annexin," includes more than about 100 annexins that have so far been identified in many species. See, e.g., Gerke V, Moss S E. Annexins: from structure to function. Physiol Rev. 2002; 82:331-371. Included within the meaning of the term "annexin," are annexin proteins identified in humans, annexins 1-11 and annexin-13. All annexins share a conserved C-terminal core domain made up of at least four similar repeats, each about 70 amino acids long. These subunits usually contain characteristic type 2 calcium binding sites. The number and location of these sites generally vary between different annexin families, with variation and replacement with other motifs. Calcium-independent annexin membrane interactions involve a switch from a helix-loop-helix motif to the transmembrane helix, which drives a reversible membrane insertion. In contrast to the core domain, individual vertebrate annexins have a unique N-terminal domain of variable length, amino acid sequences, and determinants of hydrophobicity.

The term "annexin IV," refers to proteins of the annexin A4 subfamily, which are the smallest annexin family members containing a short N-terminal region, which have been shown to be involved in repair of plasma membrane stress induced lesions. See, e.g., Boye et al., Nature Communications 8, Article No: 1623 (2017). As used herein, the term "biologically-active fragment" of annexin IV, annexin 4, can refer to a fragment of annexin IV which can be recognized by pathogenic natural antibodies that recognize annexin IV, or antibodies or antigen binding fragments thereof that are derived from such natural antibodies (e.g., the C2 antibody, the B4 antibody) which leads to development of intestinal ischemia-reperfusion injury, as has been shown by Kulik et al. J. Immunol. 2009; 182:5363-5373. Natural antibodies exist in an immune competent individual and can be found in the serum or plasma of an individual not known to have been stimulated by a specific antigen to which the antibody binds. Previous studies by the present inventors and colleagues have shown that certain types of natural antibodies recognize epitopes on ischemic tissue and catalyze the initiation and subsequent development of ischemia-reperfusion injury. See, e.g., Fleming et al., 2002, J. Immunol. 169:2126-2133; Rehrig et al., 2001, J. Immunol. 167:5921-5927). The ability of a biologically-active fragment of annexin IV to interact with or bind such pathological natural antibodies can be assayed by a variety of methods, including gel mobility shift assays, Western blot, immunoprecipitation, surface plasmon resonance, and the like.

The terms "annexin A2," "annexin II," or "annexin 2" refer to proteins of the annexin A2 subfamily, which have been shown to associate with diverse sites of actin attachment at cell membranes and serve as receptors for plasminogen and tissue plasminogen activator, positively modulating the fibrinolytic cascade, among other activities. Annexin A2 has also been identified as a component of drusen in monkeys affected with both early- and late-onset macular degeneration. See S. Umeda et al., FASEB J. (2005) 19(12): 1683-1685. As used herein, the term "biologically-active fragment" of annexin A2, annexin II, or annexin 2, refers to a fragment of annexin A2 capable of interacting with or binding to renal tubules in the kidney and interacting with or binding to factor H or a biologically active fragment thereof. The ability of a biologically-active fragment of annexin A2 to interact with or bind renal tubules or factor H can be assayed by a variety of methods, including gel mobility shift assays, Western blot, immunoprecipitation, surface plasmon resonance, and the like.

As used herein, percent (%) amino acid sequence identity is defined as the percentage of amino acids in a candidate sequence that are identical to the amino acids in a reference sequence, after aligning the sequences and introducing gaps, if necessary, to achieve the maximum percent sequence identity. Alignment for purposes of determining percent sequence identity can be achieved in various ways that are within the skill in the art, for instance, using publicly available computer software such as BLAST, BLAST-2, ALIGN, ALIGN-2 or Megalign (DNASTAR) software. Appropriate parameters for measuring alignment, including any algorithms needed to achieve maximal alignment over the full-length of the sequences being compared can be determined by known methods.

Specificity of a fusion protein construct can refer to selective recognition of the construct for a particular epitope of an antigen. Natural antibodies, for example, are monospecific. "Bispecific," according to the disclosure are fusion protein constructs, or targeting moieties within said constructs, which have two different antigen-binding specificities. Where a fusion protein construct has more than one specificity, the recognized epitopes may be associated with a single antigen or with more than one antigen. The term "valent" as used within the present disclosure can denote the presence of a specified number of binding sites in a fusion protein construct, or a targeting moiety within said construct. A natural antibody for example has two binding sites and is bivalent. As such, the terms "trivalent" denotes the presence of three binding sites in a fusion protein construct, or a targeting moiety within said construct, such as an antibody or an antigen binding fragment thereof. The term "trivalent, bispecific" antibody as used herein denotes an antibody that has three antigen-binding sites of which two bind to the same antigen (or the same epitope of the antigen) and the third binds to a different antigen or a different epitope of the same antigen. The term "tetravalent," as used herein refers to the fusion protein construct that has four binding sites that are capable of binding to the same target, such as an antigen. In some cases, CrossMab technology as described in WO 2010/145792 A1 can be used to ensure correct light chain pairing for antibodies that are bispecific.

EXAMPLES

The examples below further illustrate the described embodiments without limiting the scope of this disclosure.

Example 1: Generation of Exemplary-Complement Modulator Fusion Protein Constructs According to this Disclosure An exemplary phospholipid binding immunoglobulin sequence (e.g., C2 antibody) was obtained from hybridomas. Variable regions were fused onto a murine IgG1 framework using recombinant DNA technology, to generate a C2-IgG1 (SEQ ID NO: 51) and various antigen binding fragments, such as C2-scFv, C2-Fab. Table 2 provides a list of exemplary C2 antibodies or antigen binding fragments thereof. Such exemplary C2 antibodies or antigen binding constructs were used to generate fusion protein constructs, e.g., by linking a complement modulator protein (or a fragment thereof) to the C2 antibody or antigen binding fragment thereof. Table 3 provides a list of exemplary complement modulators that were used in generating the C2-complement modulator fusion protein constructs. Table 4 provides exemplary linkers that were used to link the exemplary C2 antibodies or antigen binding fragments thereof to the exemplary complement modulators. Orientation of the fusion protein in relation to the N-terminus or C-terminus of the C2 antibodies or antigen binding fragment thereof was explored. After codon optimization and synthesis, each DNA construct was transiently transfected in serum free media using standard methods. After harvest of culture supernatant, protein constructs were purified in a suitable manner relative to their protein structure. Some examples of the C2 constructs generated are described herein, comprising a phospholipid binding sequence or fragment thereof (exemplary sequences shown in Table 2), fused to a complement modulator (exemplary sequences shown in Table 3), optionally connected by a linker (exemplary sequences shown in Table 4). Specific examples of constructs include for instance: C2 scFv-CR1 (1-10) is a monomeric fusion protein construct comprising a CR1 (1-10) complement modulator protein connected to the light chain variable region of C2 scFv; C2 scFv-Crry is a monomeric fusion protein construct comprising a Crry complement modulator protein connected to the light chain variable region of C2 scFv; C2 Fab-Crry is a monomeric fusion protein construct comprising a Crry complement modulator protein connected to the CH1 domain of a C2-Fab; C2 Fab-CR1 (1-10) is a monomeric fusion protein comprising a CR1 (1-10) complement protein connected to the CH1 domain of a C2-Fab; C2 Fab-CR1 (1-17) is a monomeric fusion protein comprising a CR1 (1-17) complement protein connected to the CH1 domain of a C2-Fab; CR1 (1-10)-C2 Fab is a monomeric fusion protein comprising a CR1 (1-10) complement protein connected to the VH domain of a C2-Fab; CR1 (1-17)-C2 Fab is a monomeric fusion protein comprising a CR1 (1-17) complement protein connected to the VH domain of a C2-Fab; C2-IgG1-CR1 (1-10), HC C-term×2 is a tetravalent homodimeric fusion protein comprising two CR1 (1-10) complement modulator proteins, each connected to a heavy chain of C2-IgG1; C2-IgG1-CR1 (1-10), C-term×1 is a trivalent heterodimeric fusion protein comprising one CR1 (1-10) complement modulator protein connected to a heavy chain of C2-IgG1; C2-CR1 bispecific is a fusion protein comprising a CR1 complement modulator protein connected to the hinge region of a C2 IgG1 fragment; C2-IgG 1-CR1 (1-10), HC N-term×1 is a trivalent heterodimeric fusion protein comprising a CR1 (1-10) complement protein connected to a VH domain of a C2 IgG1; C2-IgG1-CR1 (1-10), LC N-term×1 is a trivalent heterodimeric fusion protein comprising a CR1 (1-10) connected to a VL domain of a C2 IgG1; C2-IgG1-CR1 (1-10), HC N-term×2 is a tetravalent homodimeric fusion protein construct comprising two CR1 (1-10) complement proteins, each connected to a VH domain of a C2 IgG1; C2-IgG1-CR1 (1-10), LC N-term×2 is a tetravalent homodimeric fusion protein comprising two CR1 (1-10) complement modular proteins, each connected to a VL domain of a C2 IgG1. FIG. 14 illustrates the structures of some of the exemplary C2 fusion protein construct as described in this example. It is contemplated that additional constructs can be prepared using complement modulators as described herein (e.g., MCP, DAF, factor H, CD59)

TABLE 2

C2-Antibodies or Antigen Binding Fragments Thereof

| Description | SEQ ID NO: |
|---|---|
| C2 IgG1 heavy chain | 51 |
| C2 IgG1 heavy chain with knob | 54 |
| C2 IgG1 heavy chain with hole | 238 |
| C2 kappa light chain | 45 |
| C2 scFv | 239 |
| C2 Fab heavy chain | 240 |
| Humanized C2 variable heavy chain | 261 |

TABLE 3

Complement Modulator

| Description | SEQ ID NO: |
|---|---|
| CR1 (1-10) | 41 |
| CR1 (1-17) | 42 |
| Crry | 7 |

TABLE 4

Exemplary Linkers

| Description | SEQ ID NO: |
|---|---|
| GGGGSGGGGSGGGGS | 241 |
| GGGGSGGGGS | 242 |

Example 2: Generation of Exemplary C3d-Complement Modulator Fusion Protein Constructs According to this Disclosure Exemplary anti-C3d sequences were obtained from hybridomas. Variable regions of heavy and light chain were ligated onto murine IgG1, kappa constant domain frameworks, respectively, using recombinant DNA technology. Exemplary clones such as C3d8b, C3d29 full length antibodies or antigen binding fragments thereof were generated. Table 5 provides a list of exemplary anti-C3d antibodies or antigen binding fragments thereof. Such exemplary anti-C3d antibodies or antigen binding constructs were used to generate fusion protein constructs, e.g., by linking a complement modulator protein (or a fragment thereof) to the anti-C3d antibody or antigen binding fragment thereof. Table 6 provides a list of exemplary complement modulators that were used in generating the anti-C3d-complement modulator fusion protein constructs. Table 7 provides exemplary linkers that were used to link the exemplary anti-C3d antibodies or antigen binding fragments thereof to the exemplary complement modulators. Orientation of the fusion protein in relation to the N-terminus or C-terminus of the C3d antibodies or antigen binding fragments thereof was explored. After codon optimization and synthesis, each DNA construct was transiently transfected in serum free media using standard methods. After harvest of culture supernatant, protein constructs were purified in a suitable manner relative to their protein structure. Some examples of the anti-C3d constructs generated are described herein, comprising a C3d binding sequence or fragment thereof (exemplary sequences shown in Table 5), fused to a complement modulator (exemplary sequences shown in Table 6), optionally connected by a linker (exemplary sequences shown in Table 7). Specific examples of the anti-C3d constructs generated are described herein, for instance: 3d29-Fab-Crry is a monomeric fusion protein construct comprising an anti-C3d Fab, the CH1 domain of which is connected to the complement modulator protein Crry. 3d29 Fab-CR1 1-10 is a monomeric fusion protein construct comprising an anti-C3d Fab, the CH1 domain of which is connected to the complement modulator protein fragment CR1 (1-10). 3d29-IgG1-CR1 (1-10), HC C-term×1 is a trivalent heterodimeric fusion protein construct comprising a CR1 (1-10) connected to a CH3 domain of an anti-C3d. IgG1. 3d29-IgG1-CR1 (1-10), HC C-term×1, KIH is a trivalent heterodimeric fusion protein construct comprising a CR1 (1-10) connected to a CH3 domain of an anti-C3d IgG1, wherein the Fc region of the anti-C3d IgG1 comprises a knob into hole structure. 3d29-IgG1-CR1 (1-10), HC C-term×2 is a tetravalent homodimeric fusion protein comprising two CR1 (1-10) complement modulator proteins, each connected to a heavy chain of an anti-C3d IgG1. 3d8b-Fab-Crry is a monomeric fusion protein construct comprising an anti-C3d Fab, the CH1 domain of which is connected to the complement modulator protein. Crry. 3d8b-Fab-CR1 (1-10) is a monomeric fusion protein construct comprising an anti-C3d Fab, the CH1 domain of which is connected to the complement modulator protein fragment CR1 (1-10). 3d8b Fab-fH 1-5 is a monomeric fusion protein construct comprising an anti-C3d Fab, the CH1 domain of which is connected to the complement modulator protein fragment factor H (1-5). 3d8b-IgG1-CR1 (1-10), HC C-term×1, KIH is a trivalent heterodimeric fusion protein construct comprising a CR1 (1-10) connected to a CH3 domain of an anti-C3d IgG1, wherein the Fc region of the anti-C3d IgG1 comprises a knob into hole structure. 3d8b-IgG1-CR1 (1-10), HC C-term×2 is a tetravalent homodimeric fusion protein comprising two CR1 (1-10) complement modulator proteins, each connected to a heavy chain of an anti-C3d IgG1. 3d8b-IgG1-CR1 (1-10), HC N-term×2 is a tetravalent homodimeric fusion protein comprising two CR1 (1-10) complement modulator proteins, each connected to the VH domain of a heavy chain of an anti-C3d IgG1. 3d8b-IgG1-CR1 (1-10), LC N-term×2 is a tetravalent homodimeric fusion protein comprising two CR1 (1-10) complement modulator proteins, each connected to the VL domain of a heavy chain of an anti-C3d IgG1. 3d8b-IgG1-CR1 (1-10), bispecific is a fusion protein comprising a CR1 complement modulator protein connected to the hinge region of an anti-C3d IgG1 fragment, wherein the Fc region of the anti-C3d IgG1 comprises a knob into hole structure. 3d8b-IgG1-fH (1-5), HC C-term×1, KIH is a trivalent heterodimeric fusion protein construct comprising a factor H (1-5) connected to a CH3 domain of an anti-C3d IgG1, wherein the Fc region of the anti-C3d IgG1 comprises a knob into hole structure. 3d8b-IgG1-fH (1-5), HC C-term×2 is a tetravalent homodimeric fusion protein comprising two factor H (1-5) complement modulator proteins, each connected to a heavy chain of an anti-C3d IgG1. 3d8b-IgG1-fH (1-5), LC C-term×2 is a tetravalent homodimeric fusion protein comprising two factor H (1-5) complement modulator proteins, each connected to a light chain of an anti-C3d IgG1. 3d8b-IgG1-fH (1-5), HC N-term×2 is a tetravalent homodimeric fusion protein comprising two factor H (1-5) complement modulator proteins, each connected to a VH domain of a heavy chain of an anti-C3d IgG1. 3d8b-IgG1-fH (1-5), LC N-term×2 is a tetravalent homodimeric fusion protein comprising two factor H (1-5) complement modulator proteins, each connected to a VL domain of a light chain of an anti-C3d IgG1. 3d8b-IgG1-fH (1-5), bispecific is a fusion protein comprising a factor H (1-5) complement modulator protein connected to the hinge region of an anti-C3d IgG1 fragment, wherein the Fc region of the anti-C3d IgG1 comprises a knob into hole structure. FIGS. 15-18 illustrate the structures of some of the exemplary anti-C3d fusion protein construct as described in this example. Examples of the format of fusion protein construct displayed in FIGS. 15-18 are tested in several assays, including hemolytic assays, LPS activation assay, assays measuring deposition of complement activation products (such as C3, C4), C1 inhibitor tests using quantitative chromogenic assays, immunochemical assays (such as ELISA, Western Blotting) for individual complement components and each fusion protein construct displays comparable activity to the complement modulator protein alone.

TABLE 5

| Anti-C3d Antibodies or Antigen Binding Fragments Thereof | |
|---|---|
| Description | SEQ ID NO: |
| 3d29-IgG1 Fab heavy chain | 58 |
| 3d29 kappa light chain | 59 |
| 3d29 heavy chain murine IgG1 | 62 |
| 3d29 heavy chain (hole) IgG1 | 64 |
| 3d29 heavy chain (knob) IgG1 | 254 |
| 3d29-Fab | 244 |
| 3d29 IgG1 heavy chain | 62 |
| 3d8b-Fab heavy chain murine IgG1 | 69 |

TABLE 5-continued Anti-C3d Antibodies or Antigen Binding Fragments Thereof

| Description | SEQ ID NO: |
|---|---|
| 3d8b kappa light chain | 68 |
| 3d8b heavy chain murine IgG1 | 73 |
| 3d8b heavy chain murine IgG1 (knob) | 74 |
| 3d8b heavy chain murine IgG1 (hole) | 81 |
| 3d8b heavy chain murine IgG1 Fc (hole) | 88 |
| 3d8b heavy chain murine IgG1 Fc (knob) | 245 |

TABLE 6

Complement Modulator

| Description | SEQ ID NO: |
|---|---|
| CR1 (1-10) | 41 |
| Factor H (1-5) | 72 |
| Crry | 7 |

TABLE 7

Exemplary Linkers

| Description | SEQ ID NO: |
|---|---|
| GGGGSGGGGSGGGGS | 241 |
| GGGGSGGGGS | 242 |

TABLE 8

B4-Antibodies or Antigen Binding Fragments Thereof

| Description |
|---|
| B4-IgG1 |
| B4-Fab |
| B4-scFv |

TABLE 9

Complement Modulators

| Description | SEQ ID NO: |
|---|---|
| CR1 (1-10) | 41 |
| CR1 (1-17) | 42 |
| Factor H (1-5) | 72 |
| Crry | 7 |
| MCP (1-4) | 187 |
| Map44 | 186 |
| CD59 | 185 |
| DAF (1-4) | 184 |

TABLE 10

Exemplary Linkers

| Description | SEQ ID NO: |
|---|---|
| GGGGSGGGGSGGGGS | 241 |
| GGGGSGGGGS | 242 |

Example 3: Generation of Exemplary B4-Complement Modulator Fusion Protein Constructs According to this Disclosure Exemplary annexin domain binding sequences (for example, a B4 antibody or fragment thereof) are obtained from hybridomas. Variable regions of heavy and light chain were ligated onto murine IgG1, kappa constant domain frameworks, respectively, using recombinant DNA technology, to generate exemplary B4 full length antibodies and antigen binding fragments thereof. Table 8 provides a list of exemplary B4 antibodies or antigen binding fragments thereof. Such exemplary B4 antibodies or antigen binding constructs are used to generate fusion protein constructs, e.g., by linking a complement modulator protein (or a fragment thereof) to the B4 antibody or antigen binding fragment thereof. Table 9 provides a list of exemplary complement modulators that are used in generating the B4-complement modulator fusion protein constructs. Table 10 provides exemplary linkers that are used to link the exemplary B4 antibodies or antigen binding fragments thereof to the exemplary complement modulators. Orientation of the fusion protein in relation to the N-terminus or C-terminus of the B4 antibodies or antigen binding fragments thereof is explored.

Some examples of B4 antibody or fragment constructs generated are described herein, comprising an annexin domain binding sequence or fragment thereof (exemplary sequences shown in Table 8), fused to a complement modulator (exemplary sequences shown in Table 9), optionally connected by a linker (exemplary sequences shown in Table 10).

Example 4: Design of an Exemplary Bifunctional Protein Construct According to this Disclosure, Containing a Knob-Hole Heterodimeric Fc Region An exemplary fusion protein construct was designed, comprising an exemplary anti-C3d antibody (3d8b) connected to a CR1 (1-10) complement modulator polypeptide, illustrated in FIG. 13. Numbering of amino acid positions mentioned in the below exemplary design is according to the EU index as in Kabat. The anti-C3d antibody comprises a light chain (domains VL and CK) comprising the sequence in SEQ ID NO: 69, a first heavy chain (domains VH-hinge-CH1-CH2-CH3; as in the sequence in SEQ ID NO: 89) comprising amino acid substitutions Thr366Ser, Met368Ala, and Tyr407Val, forming an Fc region comprising a hole, which pairs with a second heavy chain (domains hinge-CH2-CH3) Fc region comprising amino acid substitution Thr366Trp, forming an Fc region with a knob, the second heavy chain is connected to the CR1 (1-10) complement modulator polypeptide at the hinge region, via the linker $(G_4SG_4S)$ (SEQ ID NO: 242), as in the sequence of SEQ ID NO: 90.

Figure 19:
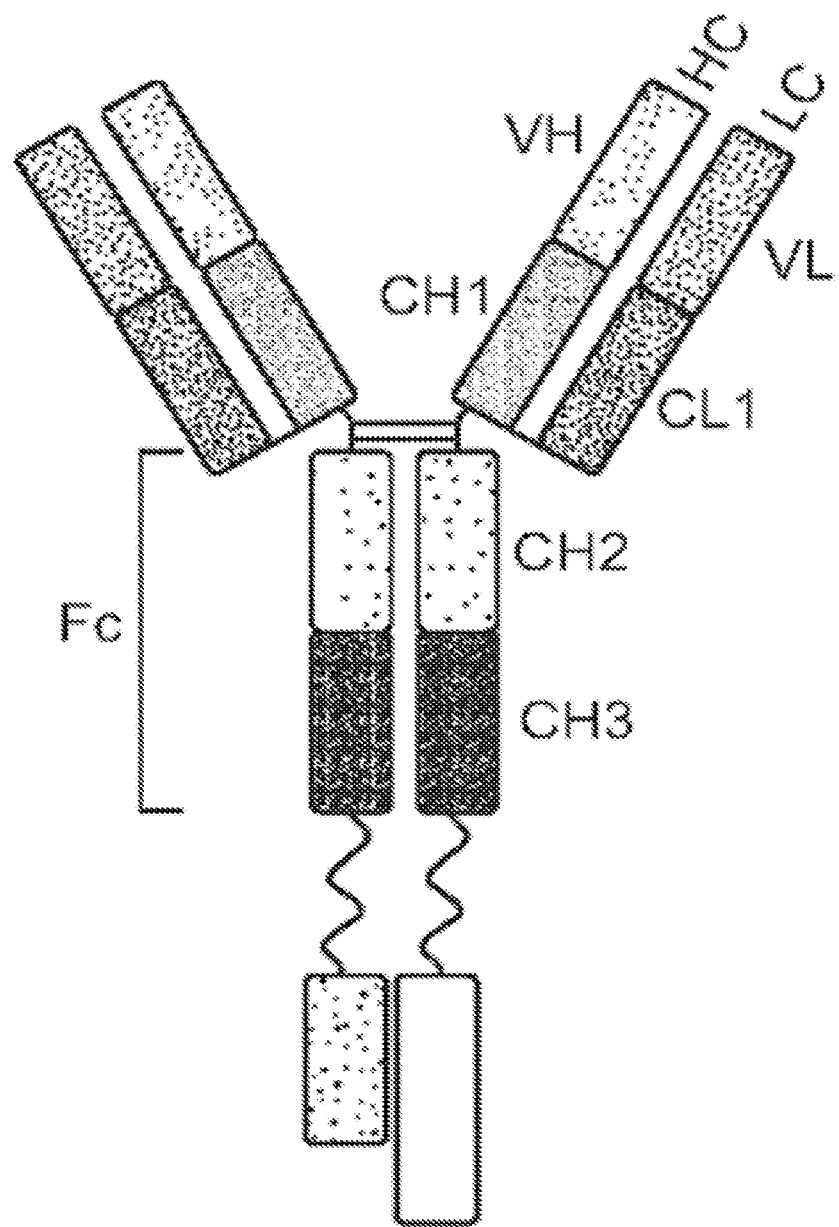
FIG. 19 illustrates an exemplary fusion protein construct of this disclosure, a tetravalent heterodimer, comprising two different complement modulator polypeptides connected to the C-terminus of a heavy chain via a polypeptide linker.
Figure 20:
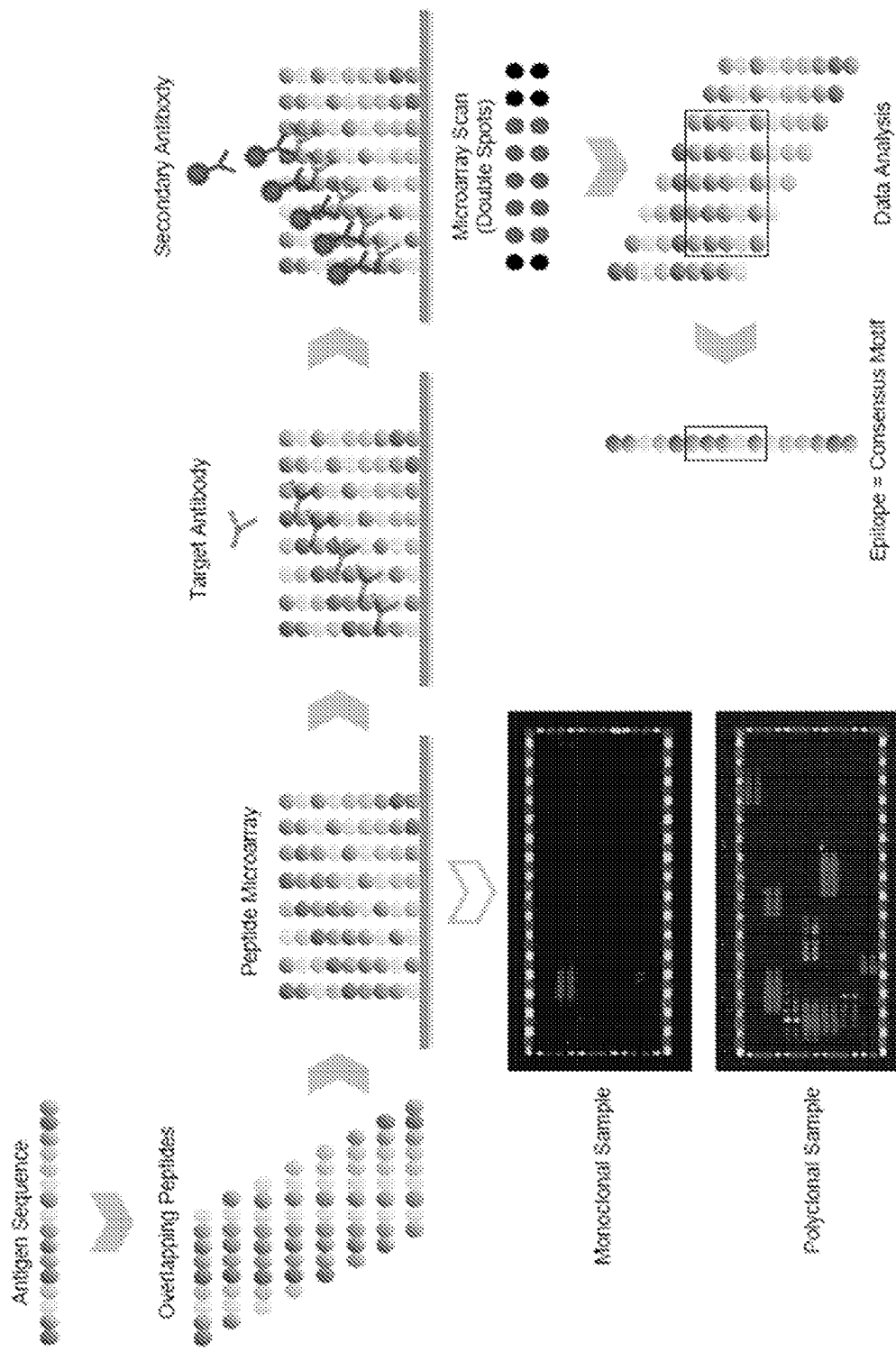
FIG. 20 illustrates PEPperMAP® Linear Epitope Mappings and the results from five mouse IgG1 antibodies against C3dg extended. The linear C3d epitopes were determined using PEPperPRINT technology (PEPperPRINT GmbH, Heidelberg, Germany). 15 amino acid long peptides derived from C3dg primary sequence offset by one amino acid were synthesized, in duplicates, on a PEPperPRINT microarray. The array was then sequentially incubated with antibodies (e.g., 3d8b, 3d9a, 3d29) and stained with secondary DyLight680 dye labeled Goat anti-mouse IgG (H+L) antibody. The microarray was read using the LI-COR Odyssey Imaging System and analyzed by PEPperPRINT.

Example 5: Design of an Exemplary Bifunctional mAb Fusion Protein Construct According to this Disclosure, Containing a Knob-Hole Heterodimeric Fc Region An exemplary mAb-fusion protein construct was designed, comprising an exemplary anti-C3d antibody (3d8b) connected to a complement modulator polypeptide, such as CR1 (1-10) CR1 (1-17), factor H (1-5), MCP (1-4), DAF, or CD59. In the example illustrated in FIG. 19, a full-length exemplary anti-C3d antibody C3d8b is connected to a first exemplary complement modulator polypeptide (such as a factor H (1-5) fragment), via one of its CH3 domain and a second exemplary complement modulator polypeptide (such as CR (1-10) fragment) via the other CH3 domain. Numbering of amino acid positions mentioned in the below exemplary design is according to the EU index as in Kabat. The exemplary anti-C3d antibody comprises light chains (domains VL and CK) comprising the sequence in SEQ ID NO: 69, a first heavy chain (domains VH-CH1-hinge-CH2-CH3) comprising amino acid substitutions Thr366Ser, Met368Ala, and Tyr407Val, forming an Fc region comprising a hole, which pairs with a second heavy chain (domains VH-hinge-CH1-CH2-CH3) Fc region comprising amino acid substitution Thr366Trp, forming an Fc region with a knob, the first heavy chain is connected to factor H at the CH3 region, via the linker (G4SG4S) (SEQ ID NO: 242), as in the sequence of SEQ ID NO: 139, the second heavy chain is connected to the CR1 (1-10) complement modulator polypeptide at the CH3 region, via the linker (G4SG4S) (SEQ ID NO: 242), as in the sequence of SEQ ID NO: 140.

Example 6: Design of an Exemplary Fusion Protein Constructs According to this Disclosure Containing Anti-C3d Antibody or an Antigen Binding Fragment Thereof An exemplary mAb-fusion protein construct was designed, comprising an exemplary anti-C3d antibody (3d8b) connected to an exemplary complement modulator polypeptide (such as decay-accelerating factor, DAF (1-4)). Numbering of amino acid positions mentioned in the below exemplary design is according to the EU index as in Kabat. The anti-C3d antibody comprises light chains (domains VL and CK) comprising the sequence in SEQ ID NO: 69, and heavy chains (domains VH-CH1-hinge-CH2-CH3). The heavy chains are connected to the DAF (1-4) at the CH3 regions, via the linker (G4SG4S) (SEQ ID NO: 242), as in the sequence of SEQ ID NO: 141.

Another exemplary mAb-fusion protein construct was designed, comprising an anti-C3d antibody (3d8b) connected to an exemplary complement modulator (such as CD59 polypeptide). Numbering of amino acid positions mentioned in the below exemplary design is according to the EU index as in Kabat. The anti-C3d antibody comprises light chains (domains VL and CK) comprising the sequence in SEQ ID NO: 69, and heavy chains (domains VH-CH1-hinge-CH2-CH3). The heavy chains are connected to the CD59 at the CH3 regions, via the linker (G4SG4S) (SEQ ID NO: 242), as in the sequence of SEQ ID NO: 142.

A further exemplary mAb-fusion protein construct was designed, comprising an exemplary anti-C3d antibody (3d8b) connected to an exemplary complement modulator (such as MAp44 polypeptide). Numbering of amino acid positions mentioned in the below exemplary design is according to the EU index as in Kabat. The anti-C3d antibody comprises light chains (domains VL and CK) comprising the sequence in SEQ ID NO: 69, and heavy chains (domains VH-CH1-hinge-CH2-CH3). The heavy chains are connected to the MAp44 at the CH3 regions, via the linker (G4SG4S) (SEQ ID NO: 242), as in the sequence of SEQ ID NO: 143.

An exemplary mAb-fusion protein construct was designed, comprising an exemplary anti-C3d antibody (3d8b) connected to an exemplary (such as MCP 1-4 polypeptide). The anti-C3d antibody comprises light chains (domains VL and CK) comprising the sequence in SEQ ID NO: 69, and heavy chains (domains VH-CH1-hinge-CH2-CH3). The heavy chains are connected to the MCP 1-4 at the CH3 regions, via the linker (G4SG4S) (SEQ ID NO: 242), as in the sequence of SEQ ID NO: 144.

Further examples of any of the fusion protein constructs illustrated in FIGS. 1-19 can comprise (a) the complement modulator sequences set out below, (b) the CDRs or the VH and VL sequences set out below, and (c) constant regions comprising at least one of CH1, hinge, CH2 or CH3 domains of human or murine immunoglobulin constant regions, or comprising one or more mutations in at least one of CH1, hinge, CH2 or CH3 domains of human or murine immunoglobulin constant regions.

TABLE 11

| Complement modulator sequence | CDRs Or VH, VL |
| --- | --- |
| SEQ ID NO: 184 | SEQ ID NOS: 11, 12 and 13; and SEQ ID NOs: 14, 15 and 16 |
| SEQ ID NO: 108 | SEQ ID NOS: 11, 12, and 13; and SEQ ID NOs: 14, 15 and 16 |
| SEQ ID NO: 72 | SEQ ID NOS: 11, 12 and 13; and SEQ ID NOs: 14, 15 and 16 |
| SEQ ID NO: 41 | SEQ ID NOS: 11, 12 and 13; and SEQ ID NOs: 14, 15 and 16 |
| SEQ ID NO: 42 | SEQ ID NOS: 11, 12 and 13; and SEQ ID NOs: 14, 15 and 16 |
| SEQ ID NO: 91 | SEQ ID NOS: 11, 12 and 13; and SEQ ID NOs: 14, 15 and 16 |
| SEQ ID NO: 92 | SEQ ID NOS: 11, 12 and 13; and SEQ ID NOs: 14, 15 and 16 |
| SEQ ID NO: 185 | SEQ ID NOS: 11, 12 and 13; and SEQ ID NOs: 14, 15 and 16 |
| SEQ ID NO: 186 | SEQ ID NOS: 11, 12 and 13; and SEQ ID NOs: 14, 15 and 16 |
| SEQ ID NO: 187 | SEQ ID NOS: 11, 12 and 13; and SEQ ID NOs: 14, 15 and 16 |
| SEQ ID NO: 184 | SEQ ID NOS: 17, 18 and 19; and SEQ ID NOS: 20, 21 and 22 |
| SEQ ID NO: 108 | SEQ ID NOS: 17, 18 and 19; and SEQ ID NOS: 20, 21 and 22 |
| SEQ ID NO: 72 | SEQ ID NOS: 17, 18 and 19; and SEQ ID NOS: 20, 21 and 22 |
| SEQ ID NO: 41 | SEQ ID NOS: 17, 18 and 19; and SEQ ID NOS: 20, 21 and 22 |
| SEQ ID NO: 42 | SEQ ID NOS: 17, 18 and 19; and SEQ ID NOS: 20, 21 and 22 |
| SEQ ID NO: 91 | SEQ ID NOS: 17, 18 and 19; and SEQ ID NOS: 20, 21 and 22 |
| SEQ ID NO: 92 | SEQ ID NOS: 17, 18 and 19; and SEQ ID NOS: 20, 21 and 22 |
| SEQ ID NO: 185 | SEQ ID NOS: 17, 18 and 19; and SEQ ID NOS: 20, 21 and 22 |
| SEQ ID NO: 186 | SEQ ID NOS: 17, 18 and 19; and SEQ ID NOS: 20, 21 and 22 |
| SEQ ID NO: 187 | SEQ ID NOS: 17, 18 and 19; and SEQ ID NOS: 20, 21 and 22 |
| SEQ ID NO: 184 | SEQ ID NO: 246, 247, 248, 249, 250, 251, 252, 253, 254, or 255; and SEQ ID NO: 256, 257, or 258. |
| SEQ ID NO: 108 | SEQ ID NO: 246, 247, 248, 249, 250, 251, 252, 253, 254, or 255; and SEQ ID NO: 256, 257, or 258. |

TABLE 11-continued

| Complement modulator sequence | CDRs Or VH, VL |
|---|---|
| SEQ ID NO: 72 | SEQ ID NO: 246, 247, 248, 249, 250, 251, 252, 253, 254, or 255; and SEQ ID NO: 256, 257, or 258. |
| SEQ ID NO: 41 | SEQ ID NO: 246, 247, 248, 249, 250, 251, 252, 253, 254, or 255; and SEQ ID NO: 256, 257, or 258. |
| SEQ ID NO: 42 | SEQ ID NO: 246, 247, 248, 249, 250, 251, 252, 253, 254, or 255; and SEQ ID NO: 256, 257, or 258. |
| SEQ ID NO: 91 | SEQ ID NO: 246, 247, 248, 249, 250, 251, 252, 253, 254, or 255; and SEQ ID NO: 256, 257, or 258 |
| SEQ ID NO: 92 | SEQ ID NO: 246, 247, 248, 249, 250, 251, 252, 253, 254, or 255; and SEQ ID NO: 256, 257, or 258 |
| SEQ ID NO: 185 | SEQ ID NO: 246, 247, 248, 249, 250, 251, 252, 253, 254, or 255; and SEQ ID NO: 256, 257, or 258 |
| SEQ ID NO: 186 | SEQ ID NO: 246, 247, 248, 249, 250, 251, 252, 253, 254, or 255; and SEQ ID NO: 256, 257, or 258 |
| SEQ ID NO: 187 | SEQ ID NO: 246, 247, 248, 249, 250, 251, 252, 253, 254, or 255; and SEQ ID NO: 256, 257, or 258 |
| SEQ ID NO: 184 | SEQ ID NO: 262, 263, 264, or 265; and SEQ ID NO: 266, 267, 268, 269. |
| SEQ ID NO: 108 | SEQ ID NO: 262, 263, 264, or 265; and SEQ ID NO: 266, 267, 268, 269. |
| SEQ ID NO: 72 | SEQ ID NO: 262, 263, 264, or 265; and SEQ ID NO: 266, 267, 268, 269. |
| SEQ ID NO: 41 | SEQ ID NO: 262, 263, 264, or 265; and SEQ ID NO: 266, 267, 268, 269. |
| SEQ ID NO: 42 | SEQ ID NO: 262, 263, 264, or 265; and SEQ ID NO: 266, 267, 268, 269. |
| SEQ ID NO: 91 | SEQ ID NO: 262, 263, 264, or 265; and SEQ ID NO: 266, 267, 268, 269. |
| SEQ ID NO: 92 | SEQ ID NO: 262, 263, 264, or 265; and SEQ ID NO: 266, 267, 268, 269. |
| SEQ ID NO: 185 | SEQ ID NO: 262, 263, 264, or 265; and SEQ ID NO: 266, 267, 268, 269. |
| SEQ ID NO: 186 | SEQ ID NO: 262, 263, 264, or 265; and SEQ ID NO: 266, 267, 268, 269. |
| SEQ ID NO: 187 | SEQ ID NO: 262, 263, 264, or 265; and SEQ ID NO: 266, 267, 268, 269. |
| SEQ ID NO: 184 | SEQ ID NO: 270, 271, 272, 273, or 274; and SEQ ID NO: 275, 276, 277, or 278. |
| SEQ ID NO: 108 | SEQ ID NO: 270, 271, 272, 273, or 274; and SEQ ID NO: 275, 276, 277, or 278. |
| SEQ ID NO: 72 | SEQ ID NO: 270, 271, 272, 273, or 274; and SEQ ID NO: 275, 276, 277, or 278. |
| SEQ ID NO: 41 | SEQ ID NO: 270, 271, 272, 273, or 274; and SEQ ID NO: 275, 276, 277, or 278. |
| SEQ ID NO: 42 | SEQ ID NO: 270, 271, 272, 273, or 274; and SEQ ID NO: 275, 276, 277, or 278. |
| SEQ ID NO: 91 | SEQ ID NO: 270, 271, 272, 273, or 274; and SEQ ID NO: 275, 276, 277, or 278. |
| SEQ ID NO: 92 | SEQ ID NO: 270, 271, 272, 273, or 274; and SEQ ID NO: 275, 276, 277, or 278. |
| SEQ ID NO: 185 | SEQ ID NO: 270, 271, 272, 273, or 274; and SEQ ID NO: 275, 276, 277, or 278. |
| SEQ ID NO: 186 | SEQ ID NO: 270, 271, 272, 273, or 274; and SEQ ID NO: 275, 276, 277, or 278. |
| SEQ ID NO: 187 | SEQ ID NO: 270, 271, 272, 273, or 274; and SEQ ID NO: 275, 276, 277, or 278. |

Example 7: Assessment of Binding of Anti-C3d Antibody., 3d8b, and Its Fusion Proteins Binding of the anti-C3d antibody, 3d8b, and its complement regulator fusions, was measured by Enzyme-Linked. ImmunoSorbent Assay (ELISA) binding assays. The binding affinity of constructs was measured by surface plasmon resonance using Biacore.

Antibody Preparations

Murine IgG1 Fc, human IgG4 Fc, antibody fragments containing a His6 epitope tag (SEQ ID NO: 296) or CR1 fusion partner containing constructs were prepared in 1× PBS containing 0.1% Bovine Serum Albumin (BSA).

Secondary antibodies were used to detect 1) murine IgG1, 2) human IgG4, 3) antibody fragments ($His_6$ epitope tag) (SEQ ID NO: 296), or 4) antibody fusion proteins containing a CR1 fusion partner. Secondary antibodies specific for murine IgG I Fc (anti-mouse IgG light-chain kappa) (Novus) were diluted 1:20,000 in 1× PBS containing 0.1% BSA. Secondary antibodies specific for human IgG4 (anti-human pFc') (Abcam) were diluted 1:30,000 in 1× PBS containing 0.1% BSA. Secondary antibodies specific for the His6 epitope tag (Abcam) (SEQ ID NO: 296) were diluted 1:5000 in 1× PBS containing 0.1% BSA. Secondary antibodies specific for CR1 (anti-CR1-biotin, Thermo Fisher) were diluted 1:2500 1× PBS containing 0.1% BSA. For detection of biotinylated antibodies, streptavidin-horseradish peroxidase (Strep-HRP, Thermo Fisher) was diluted 1:5000 in 1× PBS containing 0.1% BSA.

For detection of murine IgG1, human IgG4, or antibody fragments (His6 epitope tag (SEQ ID NO: 296)) or antibody fusion proteins containing a CR1 fusion partner, the ELISA assays were performed in 1× PBS unless otherwise noted. 2.5 µg/mL of human (Comptech Technologies), mouse (Genscript), or cyno-(Atum) C3d was coated onto the surface of microliter pates in sodium bicarbonate buffer at pH 8 (Alfa Aesar) at 4° C., overnight. C3d-coated microliter plates (Thermo Fisher) were washed three times with 1× Phosphate Buffered Saline with 0.05% Tween-20 (Sigma) (PBS-T, KPL). Coated microliter plates were blocked overnight by addition of 1× PBS containing 2% BSA. After blocking, coated plates were washed three times with PBS-T. 100 µL of diluted antibody constructs was added and incubated between 1-2 hours. Coated plates were washed three times with PBS-T. 100 µL of the appropriate secondary antibodies were added to the coated plates. If necessary, 100 µL of diluted strep-HRP was added. Plates were washed three times with PBS-T. 100 µL of 3,3',5,5'-tetramethylbenzidine (TMB, Surmodics) was added and incubated in the dark at room temperature for 10-15 minutes. Reactions were terminated by addition of an equal volume of stop solution (Surmodics). The absorbance of each well was measured at 450 nm.

Binding experiments were performed on Biacore™ 3000 at 25° C. The Assay Buffer used was 10 mM HEPES buffer (pH 7.4), 150 mM NaCl, 3 mM EDTA, 0.05% P20 (polyoxyethylenesorbitan); Regeneration Buffer was 10 mM Glycine buffer (pH 1.75); and Conjugation Buffer used was 10 mM sodium acetate buffer (pH 5). The flow rate used for capturing the ligand was 10 µL/min. The flow rate for kinetics analysis is 30 µL/min.

Flow cells 2, 3 and 4 of the CM5 chip were coated with human C3d at response units (RU) levels as indicated using EDC/NHS (N-ethyl-N'-(3-dimethyl aminopropyl carbodiimide/N-hydroxy succinimide) amine coupling method as per GE manufacturers instruction. The unoccupied sites were blocked with 1M ethanol amine. Binding of exemplary humanized antibodies to the antigen was monitored in real time. From the observed kon and koff, KD was determined. For the interactions with fast off rate, steady state kinetics was used to determine KD.

Tables 12, 13, and 14 show the ELISA $EC_{50}$ values for various exemplary anti-C3d antibodies and fusion protein constructs comprising the same. Table 15 shows the $K_D$ of exemplary antibody fusion constructs measured by BIAcore measuring binding of antibody constructs to immobilized human C3d.

TABLE 12

Human C3d $EC_{50}$ data of various fusion protein constructs: summary of average Data

| Description/Mutation | $EC_{50}$ (nM) |
|---|---|
| Exemplary construct 32 | 0.28 |
| Exemplary construct 33 | 1.11 |
| Exemplary construct 34 | 0.32 |
| Exemplary fusion construct 35 | 3.52 |
| Exemplary fusion construct 36 | 2.59 |
| Exemplary fusion construct 38 | 0.68 |
| Exemplary fusion construct 39 | 1.82 |
| Exemplary fusion construct 42 | 0.96 |
| Exemplary fusion construct 43 | 1.31 |
| Exemplary fusion construct 44 | 1.41 |
| Exemplary fusion construct 45 | 0.70 |
| Exemplary fusion construct 46 | 0.99 |
| Exemplary fusion construct 47 | 1.04 |
| Exemplary fusion construct 48 | 0.99 |
| Exemplary construct 49 | 2.28 |
| Exemplary fusion construct 50 | 0.90 |

TABLE 12-continued

Human C3d $EC_{50}$ data of various fusion protein constructs: summary of average Data

| Description/Mutation | $EC_{50}$ (nM) |
|---|---|
| Exemplary fusion construct 51 | 1.31 |
| Exemplary fusion construct 52 | 1.03 |
| Exemplary construct 53 | 0.80 |
| Exemplary construct 54 | 1.42 |
| Exemplary construct 55 | 0.24 |
| Exemplary construct 56 | 0.55 |
| Exemplary construct 58 | 0.83 |
| Exem.ilary fusion construct 59 | 0.39 |
| Exem.ilary fusion construct 60 | 0.47 |
| Exem.ilary fusion construct 61 | 0.94 |
| Exem.ilary fusion construct 62 | 1.40 |
| Exem.ilary fusion construct 63 | 1.50 |
| Exem.ilary fusion construct 64 | 1.15 |
| Exemplaw fusion construct 65 | 1.34 |
| Exemplaw fusion construct 68 | 1.00 |
| Exemplary fusion construct 69 | 1.05 |
| Exemplary fusion construct 116 | 0.55 |
| Exemplary fusion construct 118 | 0.84 |

*Unless otherwise noted, tested proteins were expressed in CHO cells

TABLE 13

Human C3d $EC_{50}$ data: Effect of humanization on target affinity

| Description/Mutation | $EC_{50}$, nM |
|---|---|
| Exemplary construct 73 | 0.021 |
| Exemplary construct 74 | 0.017 |
| Exemplary construct 75 | 0.029 |
| Exemplary construct 76 | 0.018 |
| Exemplary construct 77 | 0.011 |
| Exemplary construct 78 | 0.018 |
| Exemplary construct 79 | 0.020 |
| Exemplary construct 86 | 0.03 |

TABLE 14

Human C3d $EC_{50}$ data of humanized fusion constructs

| Description/Mutation | $EC_{50}$, nM |
|---|---|
| Exemplary construct 86 | 0.03 |
| Exemplary construct 87 | 0.02 |
| Exemplary construct 93 | 0.02 |
| Exemplary fusion construct 94 | 0.14 |
| Exemplary fusion construct 95 | 0.04 |
| Exemplary fusion construct 96 | 0.09 |
| Exemplary fusion construct 99 | 1.54 |
| Exemplary fusion construct 101 | 1.55 |
| Exemplary fusion construct 106 | 1.62 |
| Exemplary fusion construct 107 | 4.20 |
| Exemplary fusion construct 129 | 0.13 |
| Exemplary fusion construct 133 | 0.07 |
| Exemplary fusion construct 135 | 0.06 |
| Exemplary fusion construct 138 | 0.09 |
| Exemplary fusion construct 139 | 0.06 |
| Exemplary fusion construct 140 | 0.08 |
| Exemplary fusion construct 141 | 0.11 |
| Exemplary fusion construct 142 | 0.04 |
| Exemplary fusion construct 143 | 0.05 |
| Exemplary fusion construct 97 | 0.074 |
| Exemplary fusion construct 146 | 0.061 |

TABLE 15

Surface Plasmon Resonance Data from Biacore ™ 3000 Instrument using CM5 Sensor Chip with C3d antigen immobilized

| Analyte | $K_D(M)$ | Conc. of Analyte (nM) |
|---|---|---|
| Exemplary construct 32 | 3.10E-09 | 0-50 |
| Exemplary construct 33 | 2.43E-10 | 0-50 |
| Exemplary construct 34 | 8.88E-10 | 0-50 |
| Exemplary fusion construct 35 | 2.66E-07 | 0-1500 |
| Exemplary fusion construct 36 | 3.59E-07 | 0-1500 |
| Exemplary fusion construct 43 | 5.24E-09 | 0-50 |
| Exemplary fusion construct 46 | 2.72E-08 | 0-100 |
| Exemplary construct 49 | 3.34E-07 | 0-1500 |
| Exemplary fusion construct 52 | 1.55E-08 | 0-100 |
| Exemplary construct 53 | 5.99E-09 | 0-100 |
| Exemplary construct 54 | 5.01E-08 | 0-100 |
| Exemplary construct 56 | 9.10E-10 | 0-100 |
| Exemplary construct 58 | 7.02E-09 | 0-100 |
| Exemplary fusion construct 62 | 3.41E-08 | 0-100 |
| Exemplary fusion construct 64 | 1.84E-08 | 0-100 |
| Exemplary construct 72 | No Binding | 125-2000 |
| Exemplary construct 73 | 9.18E-10 | 0-100 |
| Exemplary construct 74 | 1.34E-09 | 0-100 |
| Exemplary construct 75 | 1.63E-09 | 0-100 |
| Exemplary construct 86 | 1.47E-08 | 0-100 |
| Exemplary construct 87 | 7.57E-09 | 0-100 |
| Exemplary construct 93 | 1.02E-08 | 1.56-200 |
| Exemplary fusion construct 97 | 1.19E-08 | 1.56-200 |
| Exemplary fusion construct 116 | 1.06E-08 | 1.56-200 |
| Exemplary fusion construct 118 | 9.36E-09 | 1.56-200 |
| Exemplary fusion construct 129 | 3.72E-08 | 1.56-200 |
| Exemplary fusion construct 133 | 3.80E-08 | 1.56-200 |
| Exemplary fusion construct 135 | 3.89E-08 | 1.56-200 |

Example 8: Complement Inhibition of Anti-C3d Antibody, 3d8b, and Fusion Proteins The Wieslab® Alternative and Classical pathway ELISA's (ALPCO) were performed according to manufacturer's instructions. Briefly, complement preserved human serum (CompTech) was diluted 1:18 or 1:101 in the appropriate dilution buffer provided for the Alternative or Classical kit, respectively. Test analogs were diluted into PBS (Gibco) and a dose response was generated by diluting test analogs 2-4-fold in PBS. Diluted test analogs were then added at 25× to the diluted human serum. 96 well flat bottom Wieslab plates were incubated for 1 hour at 37° C. (Thermo) and washed 3× with wash buffer provided by the kit. Antibody conjugate was then added, and the plate was incubated for 30 minutes followed by a second wash. Filially, substrate was added, the plate was incubated for another 30 minutes, and absorbance was read at 405 nm. IC50 curves were generated using PRISM software.

Table 16 shows the complement activity of different CR11-10 complement regulator fusion proteins. Table 17 shows the complement activity of CR11-17 fusion proteins for the alternative and classical pathways. Table 18 shows the complement activity of fH1-5 fusion proteins in the alternative and classical pathways.

TABLE 16

| Functional analysis of exemplary constructs with $CR1_{1-10}$ complement modulator | | | | |
|---|---|---|---|---|
| | Alternative Pathway | | Classical Pathway | |
| Construct ID | $IC_{50}$ (nM) | SD | $IC_{50}$ (nM) | SD |
| Exemplary fusion construct 106 | 4 | 1 | 90 | 44 |
| Exemplary fusion construct 95 | 11 | 4 | 105 | 30 |
| Exemplary fusion construct 96 | 11 | 6 | 107 | 40 |
| Exemplary fusion construct 52 | 12 | 2 | 63 | 29 |
| Exemplary fusion construct 46 | 12 | 4 | 79 | 6 |
| Exemplary fusion construct 36 | 13 | 0 | 156 | 65 |
| Exemplary fusion construct 133 | 13 | n/a | n/a | n/a |
| Exemplary fusion construct 139 | 14 | 2 | n/a | n/a |
| Exemplary fusion construct 138 | 15 | 3 | n/a | n/a |
| Exemplary fusion construct 39 | 17 | 5 | 95 | 47 |
| Exemplary fusion construct 99 | 23 | 12 | 140 | 47 |
| Exemplary fusion construct 43 | 29 | 10 | 62 | 14 |
| Exemplary fusion construct 51 | 30 | 12 | 147 | 45 |
| Exemplary fusion construct 50 | 35 | 12 | 169 | 31 |
| Exemplaty fusion construct 38 | 43 | 19 | 190 | 124 |
| Exemplary fusion construct 45 | 51 | 9 | 119 | 13 |
| Exemplary construct 19 | 71 | 31 | 76 | 24 |
| Exemplary construct 70 | 80 | 26 | 70 | 41 |
| Exemplary fusion construct 68 | 89 | 3 | 606 | 118 |
| Exemplary construct 58 | >300 | n/a | >300 | n/a |

TABLE 17

Functional analysis of exemplary constructs with CR1147 complement modulator

|  | Alternative Pathway | | Classical Pathway | |
| --- | --- | --- | --- | --- |
|  | $IC_{50}$ (nM) | SD | $IC_{50}$ (nM) | SD |
| Exemplary fusion construct 107 | 4 | 2 | 51 | 14 |
| Exemplary fusion construct 94 | 6 | 3 | 34 | 3 |
| Exemplary fusion construct 141 | 6 | 0 | n/a | n/a |
| Exemplary fusion construct 64 | 6 | 2 | 55 | 16 |
| Exemplary fusion construct 140 | 6 | 3 | n/a | n/a |
| Exemplary construct 72 | 6 | 3 | 35 | 12 |
| Exemplary fusion construct 129 | 7 | n/a | n/a | n/a |
| Exemplary fusion construct 100 | 7 | 5 | 65 | 13 |
| Exemplary fusion construct 63 | 9 | 2 | 84 | 17 |
| Exemplary fusion construct 65 | 10 | 4 | 84 | 3 |
| Exemplary fusion construct 62 | 19 | 2 | 112 | 10 |
| Exemplary construct 58 | >300 | n/a | >300 | n/a |

TABLE 18

Functional analysis of exemplary constructs with factor H complement modulator

| | Alternative Pathway | | Classical Pathway | |
| --- | --- | --- | --- | --- |
| Construct ID | $IC_{50}$ (nM) | SD | $IC_{50}$ (nM) | SD |
| Exemplary fusion construct 143 | 50 | 29 | n/a | n/a |
| Exemplary fusion construct 142 | 54 | 16 | n/a | n/a |
| Exemplary fusion construct 135 | 56 | n/a | n/a | n/a |
| Exemplary fusion construct 97 | 58 | 13 | n/a | n/a |
| Exemplary' fusion construct 48 | 73 | 22 | 166 | 14 |
| Exemplary fusion construct 61 | 125 | 17 | n/a | n/a |
| Exemplary fusion construct 60 | 144 | 24 | n/a | n/a |
| Exemplary fusion construct 44 | 206 | 91 | 3041 | 944 |
| Exemplary fusion construct 59 | 488 | 315 | n/a | n/a |
| Exemplary fusion construct 69 | 492 | 96 | n/a | n/a |
| Exemplary fusion construct 47 | 615 | 85 | n/a | n/a |
| Exemplary construct 71 | 1772 | 430 | n/a | n/a |
| Exemplary construct 58 (used as control) | >300 | n/a | >300 | n/a |
| Exemplary fusion construct 97 | 73.4 | 18.9 | n/a | n/a |
| Exemplary fusion construct 146 | 88.1 | 7.0 | n/a | n/a |

Example 9: Analyzing the Inhibition of the Alternative Complement Pathway Using Rabbit Erythrocytes Using Antibody Fusions Containing Complements Regulators Erythrocyte Preparation 45 ml of Dulbecco's Phosphate Buffered Saline (without $Ca^{2+}$ or $Mg^{2+}$) (dPBS, Life Technologies) was added to 0.5 ml of rabbit whole blood (BioIVT) in a 50 ml conical tube. The cellular suspension was centrifuged at 4° C. for 10 minutes at 2000 RPM. The supernatant and buffy coat were removed by decanting. The cell pellet was resuspended with 0.5 ml of dPBS.

To quantify the number of erythrocytes in the cell suspension, 50 µL of suspended cells were added to 700 µL of distilled water. The cell suspension was vortexed until the cells lysed. The optical density of the lysate was measured at 541 nm. The $OD_{541}$ of the lysed cell sample was used to adjust the concentration of the 0.5 ml resuspended cells to $2.9\times10^9$ cells/ml by dividing the $OD_{541}$ by 0.2 and multiplying by $2.9\times10^9$.

Reagent Preparation

All reagents were maintained at 4° C. All tubes, plates, and solutions were maintained on ice. A fresh solution of Mg-EGTA was prepared by mixing 0.25 mL of 1M $MgCl_2$ (Boston BioProducts) and 0.5 mL of 0.5M EGTA (Boston BioProducts) at pH 7.4. A diluted Mg-EGTA solution was prepared by mixing 0.45 mL Mg-EGTA with 0.55 mL dPBS, 10 ul of diluted Mg-EGTA was added to each sample well of the assay plate. Human serum (BioIVT) was thawed in a 37° C. water bath. The references and controls required for this assay are a positive control, serum background, and CAP block control. The solution were prepared in the appropriate concentration and diluted in a separate plate. 100 µL of each control in duplicate was transferred to the corresponding wells on the TEST plate.

Test constructs were diluted in normal human serum to a concentration of 10 µM. Serial dilutions were prepared at 1:2 with normal human serum. 100 µL of diluted inhibitors were added to the respective wells in the assay plate (R&D Systems). 5 µL of dPBS was added to serum background wells. 5 µL diluted erythrocytes are added to all remaining wells in the assay plate. Wells were gently mixed by gentle pipetting. The assay plate was sealed and incubated for 30 minutes at 37° C.

Preparation of Stop Solution

A 25 mM EDTA solution in water (EDTA-H20) was prepared by adding 20 µL of 0.5 M EDTA (Corning) into 380 µL of water (1:20). A 25 mM EDTA solution in dPBS (EDTA-PBS) was prepared by adding 400 µL of 0.5 M EDTA into 7.6 mL of dPBS (1:20).

In order to terminate the complement activity, 100 µL of EDTA-H20 was added to the water controls, whereas 100 µL of EDTA-PBS was added to the remaining wells. The plate was spun at 1800 rpm for 10 minutes at 4°. 100 µL of the well volume was transferred to a new microplate and was measured at 415 nm (SpectraFluorPlus, Tecan). Data was exported and analyzed by calculating the Percent Lysis with the following equation:

$$\text{Percent lysis} = \frac{A_{415(test\ construct)} - A_{415(serum\ background)}}{A_{415(water)}} \times 100$$

The data was plotted as percent lysis versus log(inhibitor concentration) The data was normalized to positive and negative controls and IC50 calculated with the following parameters and equation: variable slope and 4 parameter fit.

$$Y = \text{Bottom} + \frac{\text{Top} - \text{Bottom}}{(1 + 10^{((log(IC50)-X)*HillSlope)})}$$

$IC_{50}$ values for soluble $CR1_{1-10}$, $CR1_{1-17}$, and $fH_{1-5}$ complement regulators and their fusion proteins are shown in Tables 19, 20, and 21.

TABLE 19

$IC_{50}$ data: Targeted vs. non-targeted CR1140 constructs from complement alternative pathway, averaged data

| Compound ID | Targeted/Non-targeted | $IC_{50}$, μM | SD |
|---|---|---|---|
| Exemplary construct 19 | Non-targeted | 1.16 | 0.16 |
| Exemplary construct 70 | Non-targeted | 1.01 | 0.36 |
| Exemplary fusion construct 38 | Targeted | 0.58 | 0.10 |
| Exemplary fusion construct 39 | Targeted | 0.18 | 0.02 |
| Exemplary fusion construct 43 | Targeted | 0.37 | 0.01 |
| Exemplary fusion construct 45 | Targeted | 0.28 | 0.02 |
| Exemplary fusion construct 46 | Targeted | 0.12 | 0.02 |
| Exemplary fusion construct 50 | Targeted | 0.26 | 0.01 |
| Exemplary fusion construct 51 | Targeted | 0.42 | 0.04 |
| Exemplary fusion construct 52 | Targeted | 0.16 | 0.01 |
| Exemplary construct 58 | Targeted | >10 | NA |
| Exemplary fusion construct 68 | Targeted | 0.67 | 0.08 |
| Exemplary construct 93 | Targeted | >10 | NA |
| Exemplary fusion construct 95 | Targeted | 0.26 | 0.04 |
| Exemplary fusion construct 96 | Targeted | 0.20 | 0.05 |
| Exemplary fusion construct 99 | Targeted | 0.34 | 0.04 |
| Exemplary fusion construct 106 | Targeted | 0.17 | 0.11 |
| Exemplary fusion construct 138 | Targeted | 0.57 | NA |
| Exemplary fusion construct 139 | Targeted | 0.64 | NA |

TABLE 20

$IC_{50}$ data: Targeted vs non-targeted $CR1_{1-17}$ constructs from complement alternative pathway, averaged data

| Compound ID | Targeted/Non-targeted | $IC_{50}$, μM | SD |
|---|---|---|---|
| Exemplary construct 20 | Non-targeted | 0.09 | 0.02 |
| Exemplary construct 72 | Non-targeted | 0.09 | 0.01 |
| Exemplary construct 58 | Targeted | >10 | NA |
| Exemplary fusion construct 62 | Targeted | 0.13 | 0.02 |
| Exemplary fusion construct 63 | Targeted | 0.13 | 0.02 |
| Exemplary fusion construct 64 | Targeted | 0.31 | 0.10 |
| Exemplary fusion construct 65 | Targeted | 0.26 | 0.23 |
| Exemplary construct 93 | Targeted | >10 | NA |
| Exemplary fusion construct 94 | Targeted | 0.29 | 0.12 |
| Exemplary fusion construct 107 | Targeted | 0.21 | 0.07 |
| Exemplary fusion construct 140 | Targeted | 0.91 | NA |
| Exemplary fusion construct 141 | Targeted | 1.3 | NA |

TABLE 21

$IC_{50}$s: Targeted vs non-targeted $fH_{1-5}$ constructs from complement alternative pathway, averaged data

| Compound ID | Targeted/Non-targeted | $IC_{50}$, μM | SD |
|---|---|---|---|
| Exemplary construct 71 | Non-targeted | 4.54 | 0.53 |
| Exemplary construct 58 | Targeted | >10 | NA |
| Exemplary fusion construct 44 | Targeted | 0.90 | 0.15 |
| Exemplary fusion construct 47 | Targeted | 2.26 | 0.63 |
| Exemplary fusion construct 48 | Targeted | 0.26 | 0.06 |
| Exemplary fusion construct 59 | Targeted | >10 | NA |
| Exemplary fusion construct 60 | Targeted | 0.93 | 0.26 |
| Exemplary fusion construct 61 | Targeted | 6.08 | 163 |
| Exemplary fusion construct 69 | Targeted | 8.32 | 2.23 |
| Exemplary construct 93 | Targeted | >10 | NA |
| Exemplary fusion construct 97 | Targeted | 0.30 | 0.01 |
| Exemplary fusion construct 142 | Targeted | 0.97 | NA |
| Exemplary fusion construct 143 | Targeted | 0.99 | NA |
| Exemplary fusion construct 97 | Targeted | 0.64 | 0.04 |
| Exemplary fusion construct 146 | Targeted | 0.46 | 0.02 |

Example 10: Analyzing Inhibition of the Classical Complement Pathway Using Sheep Erythrocytes Sensitization of Sheep Red Blood Cells (SRBC) with Hemolysin 2 mL of SRBCs (BioIVT) were added to 3 mL of $GVB^{++}$ buffer (Boston BioProducts) and mixed gently. The SRBC suspension was centrifuged at 4° C. for 5 minutes at 2000 RPM. The supernatant was decanted, and the pellet resuspended in $GVB^{++}$ buffer. The SRBC suspension was centrifuged for 5 minutes at 4° C. at 2000 RPM. The supernatant was decanted again. 9 mL of $GVB^{++}$ buffer was added to the pellet to prepare a 10% cell suspension. Hemolysin (Rockland) was prepared by resuspending dry powder with 2 mL milliQ water and stored at −20° C., at an estimated concentration of about 80 mg/mL (lyophilized powder reconstituted in 2 mL per manufacturer's instructions). An equal volume of hemolysin (equal to the volume of 10% SRBC suspension) was prepared by diluting the stock hemolysin 1:100 in $GVB^{++}$ buffer. Diluted hemolysin was added dropwise to the 10% SRBC suspension and mixed gently by swirling. The solution was incubated at 30° C. for 30 minutes in a water bath and swirled every 15 minutes. Sensitized SRBCs were stored overnight at 4° C.

Determination of $CH_{50}$

The $CH_{50}$ test was used to determine the optimal concentration of serum to use in the inhibitor assay. A 1:2 dilution series of human serum was prepared in $GVB^{++}$ buffer. Serum was initially diluted 1:4 in $GVB^{++}$ buffer (100 μL serum in 300 μL $GVB^{++}$). 200 μL of diluted serum was added to the dilution series tubes. After generating the serum dilutions, 200 μL of sensitized sheep SRBC (sSRBC) was added to each diluted serum tube. 200 μL of water was added to serve as a 100% lysis control. The negative control was prepared by addition of sRBCs to $GVB^{++}$ without serum. The samples were incubated in a 37° C. water bath. Samples were centrifuged for 5 minutes at 2000 RPM to pellet sSRBCs. 100 μL of the supernatant was transferred to a 96-well microliter plates and 100 μL of water was added to each well. The absorbance was measured at 541 nm. 50% lysis ($CH_{50}$) was calculated by plotting % lysis versus serum dilution.

Assessment of Inhibitors of the Classical Complement Pathway

Test constructs were diluted in 2× human serum. All test constructs were diluted to 10 µM. A 12-point 1:2 dilution series of the test constructs by diluting with 2× human serum. 100 of sample was transferred to a fresh tube. 100 µL of GVB buffer was added to each tube. 100 µL of sSRBC was added to each tube. The appropriate 100% lysis and GVB$^{++}$ buffer controls were prepared. Samples were incubated at 37° C. for 30 minutes in a water bath. Samples were centrifuged for 10 minutes at 2000 RPM. 100 µL of supernatant was transferred to a 96-well microtiter plate. 100 µL of diH2O was added to each well and the absorbance measured at 541 nm.

The averages for each sample was obtained and the background absorbance was subtracted from the GVB$^{++}$ buffer control well. Percent lysis was calculated for each dilution with the following equation:

$$\% \text{ lysis} = 100 \times \frac{OD_{541(test\ construct)} - OD_{541(GVB\ control)}}{OD_{541(100\%\ lysis)} - OD_{541(GVB\ control)}}$$

Table 22 shows the IC$_{50}$ of the classical complement pathway test constructs.

TABLE 22

Inhibition of the complement classical pathway

| Compound ID | IC$_{50}$, uM |
|---|---|
| Exemplary construct 19 | 3.43E-02 |
| Exemplary fusion construct 38 | 3.13E-02 |
| Exemplary fusion construct 39 | 3.03E-03 |
| Exemplary fusion construct 43 | 2.69E-02 |
| Exemplary fusion construct 45 | 3.98E-02 |
| Exemplary fusion construct 46 | 5.02E-04 |
| Exemplary fusion construct 50 | 4.80E-02 |
| Exemplary fusion construct 52 | 2.07E-03 |
| Exemplary fusion construct 68 | 2.90E-01 |
| Exemplary construct 70 | 5.23E-03 |
| Exemplary construct 20 | 1.02E-02 |
| Exemplary fusion construct 62 | 3.60E-02 |
| Exemplary fusion construct 64 | 2.16E-02 |
| Exemplary fusion construct 65 | 5.51E-02 |
| Exemplary construct 72 | 1.32E-02 |
| Exemplary fusion construct 44 | >1 |
| Exemplary fusion construct 47 | >1 |
| Exemplary fusion construct 48 | 4.32E-01 |
| Exemplary fusion construct 59 | >1 |
| Exemplary construct 71 | >1 |
| Exemplary construct 58 | >1 |
| Exemplary construct 92 | 1.09E-01 |
| BB5.1, Hycult (anti-mouse C5 antibody) | 1.06E-01 |

Example 11: Evaluation of Anti-Phospholipid Antibody, C2, Binding to Cardiolipin 96-well plates (Thermofisher) were coated with 50 µL of Cardiolipin (Sigma) in coating buffer (100% ethanol) (Sigma). Plates were incubated overnight while loosely covered (USA Scientific) to enable evaporation of ethanol. Coated plates were blocked with 300 µL of Echelon custom blocking buffer (Echelon) and incubated for at least 2 hours at room temperature. Wells were aspirated and 100 µL of diluted sample in Echelon custom buffer was added to each well. Wells were incubated for at least 90 minutes at room temperature. Plates were washed three times with PBS and dried on paper towels. 100 µL of PBS-diluted secondary antibodies were added to the appropriate wells. For detections of C2-IgM, goat anti-mouse IgM (Southern Biotech) was diluted at 1:5,000. For detection of C2 IgG1 (murine), rabbit anti-mouse light chain kappa (Abcam) was diluted at 1:10,000. For detection of C2-IgG1 (human), mouse anti-human pFc' (Abcam) was diluted at 1:20,000. For detection of C2 fragments with a His$_6$ epitope tag (SEQ ID NO: 296), goat anti-6× His (Abcam) was diluted at 1:5,000. After addition and incubation of secondary antibodies, plates were washed three times with PBS. Plates were developed by addition of 100 µL of BioFx Supersensitive TMB (Surmodics). Plates were incubated in the dark for 15 minutes. The reactions were terminated by addition of 100 µL of stop solution (Surmodics) and the absorbance was measured at 450 nm.

Table 23 shows EC$_{50}$ values obtained for the C2 constructs assayed in the cardiolipin ELISA binding assay. Table 24 shows EC$_{50}$ values obtained for the humanized variants (human IgG4) in the cardiolipin ELISA binding assay.

TABLE 23

Cardiolipin EC$_{50}$ for C2 constructs

| Construct Description | EC$_{50}$, nM |
|---|---|
| C2 IgM | 0.154 |
| C2 scFv-Crry | 5.4 |
| C2 scFv-Crry | 3.9 |
| C2-hIgG4 | 2.9 |
| C2-muIgG1 | 5.7 |
| CR1$_{1-10}$ | 30.8 |
| CR1$_{1-17}$ | 14 |
| C2 scFv-CR1$_{1-10}$ | 2.8 |
| C2-muIgG1 | 6.4 |
| C2 Fab-CR1$_{1-10}$, C-term | 2.65 |
| C2 Fab-CR1$_{1-10}$, N-term | 2.9 |
| C2 muIgG1, CR1$_{1-10}$, C-term HC x 1 | 0.37 |
| C2 muIgG1, CR1$_{1-10}$, N-term HC x 1 | 0.95 |
| C2 muIgG1, CR1$_{1-10}$, N-term LC x 1 | 0.76 |
| C2 muIgG1, CR1$_{1-10}$, N-term HC x 2 | 0.7 |
| C2 muIgG1, CR1$_{1-10}$, N-term LC x 2 | 0.9 |

TABLE 24

Cardiolipin EC$_{50}$ of C2 humanized variants on a human IgG4 backbone

| Construct Description | SEQ ID No. (VH/HC) | SEQ ID No. (VL/LC) | EC$_{50}$, nM |
|---|---|---|---|
| C2 VH0Vκ0 | 98 | 45 | 1.51 |
| C2 VH0Vκ1 | 98 | 266 | <0.8 |
| C2 VH1Vκ0 | 261 | 45 | <0.8 |
| C2 VH1Vκ1 | 261 | 266 | <0.8 |
| C2 VH1Vκ2 | 261 | 267 | <0.8 |
| C2 VH1Vκ3 | 261 | 268 | 0.50 |
| C2 VH1Vκ4 | 261 | 269 | 0.59 |
| C2 VH2Vκ1 | 262 | 266 | <0.8 |
| C2 VH2Vκ2 | 262 | 267 | <0.8 |
| C2 VH2Vκ3 | 262 | 268 | 0.52 |
| C2 VH2Vκ4 | 262 | 269 | 0.47 |
| C2 VH3Vκ1 | 263 | 266 | <0.8 |
| C2 VH3Vκ2 | 263 | 267 | <0.8 |
| C2 VH3Vκ3 | 263 | 268 | 0.47 |
| C2 VH3Vκ4 | 263 | 269 | 0.59 |

TABLE 24-continued

Cardiolipin EC$_{50}$ of C2 humanized variants on a human IgG4 backbone

| Construct Description | SEQ ID No. (VH/HC) | SEQ ID No. (VL/LC) | EC$_{50}$, nM |
|---|---|---|---|
| C2 VH4Vκ1 | 264 | 266 | <0.8 |
| C2 VH4Vκ2 | 264 | 267 | <0.8 |
| C2 VH4Vκ3 | 264 | 268 | 0.54 |
| C2 VH4Vκ4 | 264 | 269 | 0.48 |
| C2 VH5Vκ1 | 265 | 266 | <0.8 |
| C2 VH5Vκ2 | 265 | 267 | <0.8 |
| C2 VH5Vκ3 | 265 | 268 | 0.48 |
| C2 VH5Vκ4 | 265 | 269 | 0.41 |

Example 12: Evaluation of the Inhibitory Potency of 3d8b Fusion Proteins in a Human Microvascular Endothelial Cell (HMEC) Injury Assay 96-well plates were coated with collagen by adding 50 μL of 0.1 mg/ml gelatin-based coating solution (Cell Biologic) for at least 5 minutes. An HMEC cell suspension was prepared at a cell density of 320,000 cells/mL in complete culture media. Gelatin solution was removed and a 200 μL of cell suspension was dispensed into each well of a TrueLine Cell culture plate (MedSupply Partners). Seeded cells were incubated in standard culturing conditions for at least 48 hours or until confluency was reached. Test media was prepared by mixing a solution of 0.1% dextrose (Sigma), 28 mM Trizma Base (Sigma), 0.5% BSA (Jackon 1 mm. Research) in HBSS media (Fisher Scientific) at pH 7.3. A solution of 100 mM H$_2$O$_2$ was prepared by diluting 30% H$_2$O$_2$ 1:100 or 10 μM ADP (Chrono) in test media. The HMEC monolayer was gently washed with test media three times to remove residual culture media ensuring that the monolayer remains intact. After washing, 50 μL of 100 mM H$_2$O$_2$ or 10 μM ADP was added and the plates were incubated at 37° C. supplemented with 5% CO$_2$ for exactly 10 minutes. The 50 μL of 100 mM H$_2$O$_2$ or 10 μM ADP was removed and the HMEC monolayer was gently washed with test media three times. To assess C3 fragment (C3b/iC3b) deposition, 50 μL of 25% human serum (CompTech) diluted in test media (premixed with or without fusion proteins) was added to wells. The plates were incubated for 60 minutes at 37° C. supplemented with 5% CO2. Cells were washed three times with test media to remove residual serum.

Treated cells were fixed with 4% paraformaldehyde in test media at room temperature for 10 minutes. Fixed cells were washed with test media three times. Fixed cells were blocked with 5% BSA in test media at room temperature for 30 minutes and washed with test media once. For C3 fragment (C3b/iC3b) staining, cells were stained by addition of 50 μL per well of FITC-rabbit anti-human C3c (Agilent/Dako) at a 1:200 dilution. Stained samples were incubated for 60 minutes in the dark. After incubation, samples were washed three times with test media and counterstained with addition of 50 μL of diluted DAPI (1:10,000 DAPI in PBS) per well. Counterstained samples were incubated in the dark at room temperature for 5 minutes. The DAPI counterstain was replaced with 100 μL of PBS. Imaging of stained samples was performed on a BioTek Cytation1 imaging station in either the FITC or PE channel at 10× magnification using Gen5 3.05 software.

Table 25 shows IC$_{50}$ values for the tested CR1$_{1-10}$ constructs in the H$_2$O$_2$ HMEC injury assay. Table 26 shows IC$_{50}$ values for CR1$_{1-17}$ constructs used in the H$_2$O$_2$ HMEC injury assay. Table 27 shows IC$_{50}$ values for CR1$_{1-10}$ constructs tested in the ADP-HMEC injury assay. Table 28 shows IC$_{50}$ values for CR1$_{1-17}$ constructs used in the ADP HMEC injury assay.

TABLE 25

Targeted vs. Non-Targeted CR1$_{1-10}$ constructs in H$_2$O$_2$-HMEC assay

| Compound ID | Targeted/Non-targeted | IC50, nM | SD |
|---|---|---|---|
| Exemplary construct 70 | Non-targeted | 21.11 | 8.93 |
| Exemplary fusion construct 43 | Targeted | 6.32 | 2.06 |
| Exemplary fusion construct 45 | Targeted | 18.2 | n/a |
| Exemplary fusion construct 46 | Targeted | 2.13 | 1.39 |
| Exemplary fusion construct 51 | Targeted | 22.9 | n/a |
| Exemplary fusion construct 52 | Targeted | 6.13 | 5.17 |
| Exemplary construct 58 | Targeted | No Inhibition | n/a |
| Exemplary construct 93 | Targeted | No Inhibition | n/a |
| Exemplary fusion construct 95 | Targeted | 0.58 | n/a |
| Exemplary fusion construct 96 | Targeted | 2.07 | 0.90 |
| Exemplary fusion construct 99 | Targeted | 4.8 | n/a |
| Exemplary fusion construct 106 | Targeted | 1.05 | 0.06 |

TABLE 26

Targeted vs. Non-Targeted CR1$_{1-17}$ constructs in H$_2$O$_2$-injured HMEC assay

| Compound ID | Targeted/Non-targeted | IC$_{50}$, nM | SD |
|---|---|---|---|
| Exemplary construct 72 | Non-targeted | 1.73 | 0.58 |
| Exemplary fusion construct 62 | Targeted | 1.39 | 0.20 |
| Exemplary fusion construct 64 | Targeted | 0.77 | 0.50 |
| Exemplary fusion construct 65 | Targeted | 1.35 | 0.13 |
| Exemplary fusion construct 94 | Targeted | 0.18 | 0.04 |
| Exemplary fusion construct 107 | Targeted | 0.98 | 0.21 |

TABLE 27

Targeted vs. Non-Targeted CR1 (1-10) contruct, in ADP-HMEC assay

| Compound ID | Targeted/Non-targeted | IC$_{50}$, nM | SD |
|---|---|---|---|
| Exemplary construct 70 | Non-targeted | 8.90 | 2.35 |
| Exemplary construct 93 | Targeted | No Inhibition | n/a |
| Exemplary fusion construct 95 | Targeted | 1.42 | 0.48 |
| Exemplary fusion construct 96 | Targeted | 1.75 | 1.44 |
| Exemplary fusion construct 99 | Targeted | 2.21 | 0.83 |
| Exemplary fusion construct 106 | Targeted | 0.62 | 0.4 |

TABLE 28

Targeted vs. Non-Targeted CR1 (1-17) constructs in ADP-HMEC assay

| Compound ID | Targeted/Non-targeted | IC$_{50}$, nM | SD |
|---|---|---|---|
| Exemplary construct 72 | Non-targeted | 1.28 | 0.31 |
| Exemplary construct 58 | Targeted | No inhibition | n/a |
| Exemplary construct 93 | Targeted | No Inhibition | n/a |
| Exemplary fusion construct 94 | Targeted | 0.13 | 0.07 |
| Exemplary fusion construct 107 | Targeted | 0.12 | 0.02 |
| Exemplary fusion construct 100 | Targeted | 0.25 | 0.03 |

Example 13: Evaluation of the Effects of Complement Inhibitors in Factor H Deficient (cfh$^{-/-}$) Mice Effects of Complement Inhibitors in cfh$^{-/-}$ Mice 72 Hours After Treatment Female cfh$^{-/-}$ mice at 3-4 months of age were treated with the following: 1) PBS, n=6; 2) 3d8b—CR1$_{1-17}$, n=5; 3) 3d8b-hfH$_{1-5}$, n=5; 4) soluble CR1$_{1-17}$ (sCR$_{1-17}$), n=5; or 5) soluble factor H (sfH$_{1-5}$), n=5. The treatment groups were given a single intravenous (IV) injection and sacrificed 72 hours later. A control group of 4 month old female cfh$^{-/-}$ (n=4) was administered one IV injection of soluble 3d8b-G1 and sacrificed 72 hours later. Untreated, age-matched wild-type mice were also used as a control by following the study during the same time period.

Serum C3 levels were measured by ELISA at the start and conclusion of the study. Plasma transaminase (ALT and AST) was measured at the conclusion of the study using a Reflotron® test (The Reflotron® test uses reagent strips for specific testing of important clinical-chemistry parameters directly from whole blood, plasma or serum. The direct use of whole blood is made possible through an integrated plasma separation pad. Various tests can also be run using urine). Upon sacrifice, kidneys and livers were harvested and measured for C3 deposits by immunofluorescence (IF).

Figure 32A:
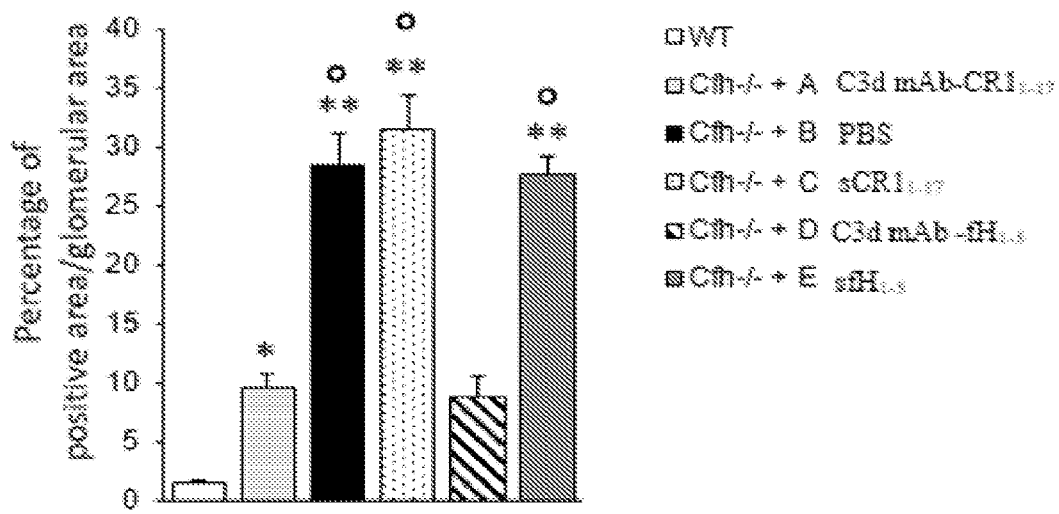
FIGS. 32A-32B show quantification of C3 positive staining is expressed as percentage of total glomerular area (ImageJ software analyses) or semi-quantitative scoring.
Figure 32B:
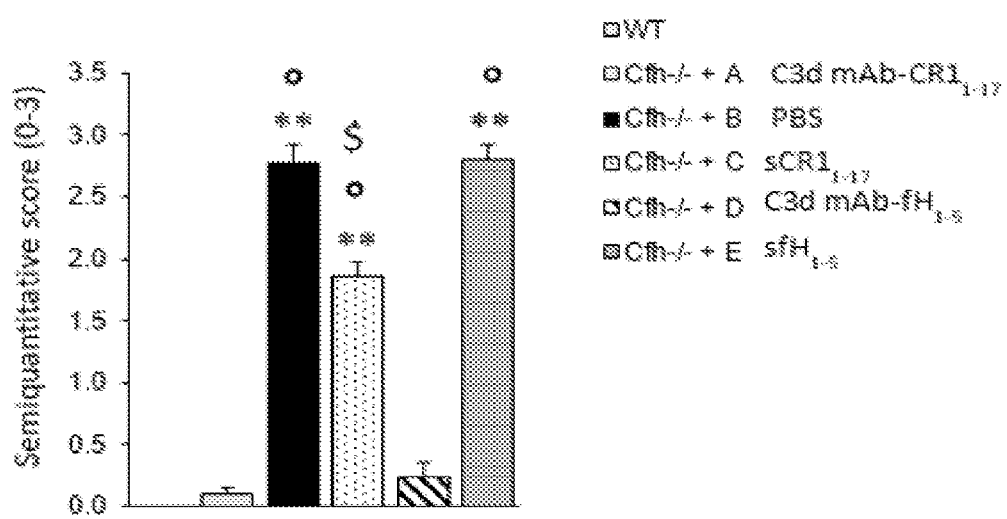

FIG. 32A shows the staining of glomerular C3 deposits in harvested kidneys 72 hrs after treatment measured by IF. Quantification of C3 positive staining in 10 glomeruli per tissue section was expressed as percentage of total glomerular area (Image) software analyses). Data are expressed as mean±SE. *p<0.05, **p<0.0001 vs WT; °p<0.0001 vs Cfh-/-+A and +D (one-way ANOVA with Tukey's post hoc test). FIG. 32B shows the C3 deposits of harvested livers 72 hrs after treatment using IF. For liver quantification, 10-15 non-overlapping fields were analyzed at 400× magnification. Semiquantitative scoring for liver stainings are as follows: 0=absent; 1=faint; 2=moderate; 3=intense staining. Results are mean SE. *p<0.05; **p<0.0001 vs WT; °p<0.0001 vs Cfh-/-+A and +D; $^{\$}$p<0.0001 vs Cfh-/-+B and +E (one-way ANOVA with Tukey's post hoc test).

Effects of Complement Inhibitors on cfh$^{-/-}$ Mice 72 Hours After Treatment

Male mice at age 4-5 months were treated with the following (all groups n=3): 1) 3d8b-CR1$_{1-17}$, 2) 3d8b-mfH$_{1-5}$, 3) 3d8b-Crry, or 4) 3d8b. Compounds were administered via IV injection on days 1 and 2. On day 9, the mice were sacrificed. Serum C3 levels were measured by ELISA at baseline (pre-treatment) and at the end of the study. Plasma transaminase (ALT and AST) were measured by a Reflotron® test. Upon sacrifice, kidneys and livers were harvested and C3 deposits were measured by IF.

Figure 33A:
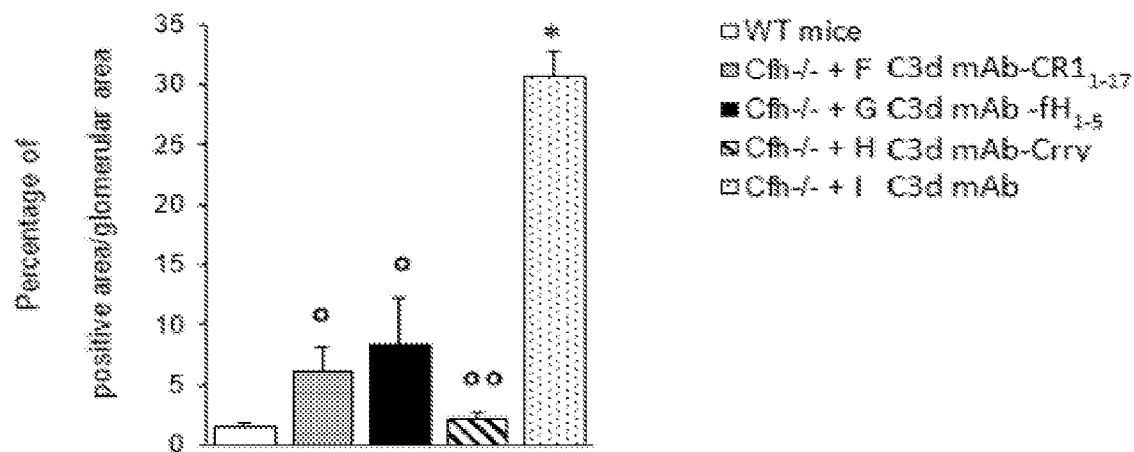
FIGS. 33A-33B show quantification of C3 positive staining is expressed as percentage of total glomerular area (ImageJ software analyses) or semi-quantitative scoring.

FIG. 33A shows the staining of glomerular C3 deposits in harvested kidneys 7 days after the last injection measured by IF. Quantification of C3 positive staining in 10 glomeruli per tissue section was expressed as percentage of total glomerular area (ImageJ software analyses). Data are expressed as mean±SE. *p<0.0001 vs WT mice; °p<0.001, °p<0.0001 vs Cfh$^{-/-}$+I mice (one-way ANOVA with Tukey's post hoc test).

Figure 33B:
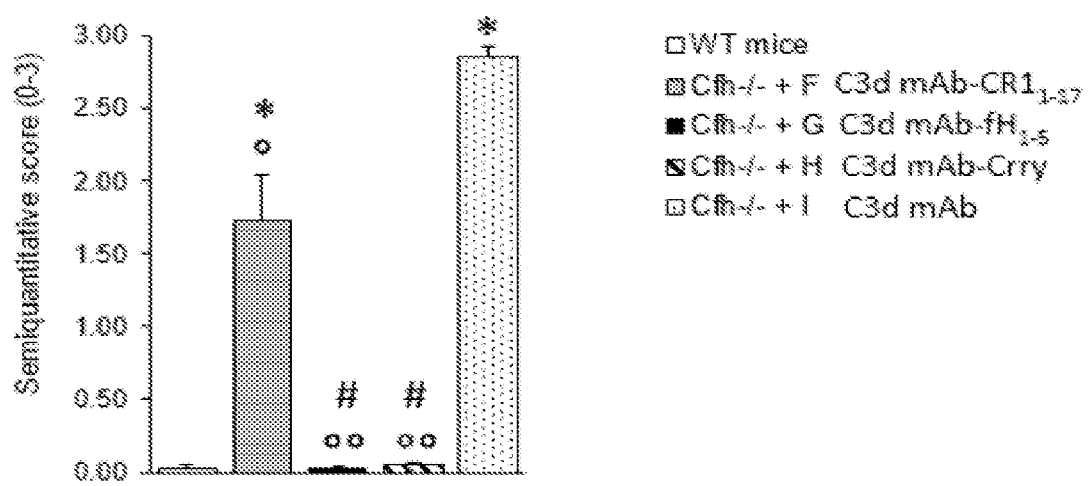

FIG. 33B shows the C3 deposits of harvested livers using IF. For liver quantification, 10-15 non-overlapping fields were analyzed at 400× magnification. Semiquantitative scoring for liver stainings are as follows: 0=absent; 1=faint; 2=moderate; 3=intense staining. Data are expressed as mean±SE and analyzed using a one-way ANOVA test using Tukey's post hoc test. *p<0.0001 vs WT mice; °p<0.001, °p<0.0001 vs cfh$^{-/-}$+I mice, #p<0.0001 vs Cfh$^{-/-}$ mice+F.

Table 29 shows levels of serums C3 levels in tested animals. Table 30 shows the levels of measured plasma transaminase of tested animals. Table 31 shows levels of serum C3 levels in tested animals. Table 32 shows the levels of measured plasma transaminase of tested animals.

TABLE 29

Evaluation of serum C3 levels in 4-month old female wild-type and cfh$^{-/-}$ mice

| Genotype | Treatment | Baseline μg/mL | 72 hours after single injection μg/mL |
|---|---|---|---|
| Wildtype | none | 1020.4 +/− 49.88 | 929.40 +/− 34.13 |
| cfh -/- | Exemplary fusion construct 64 | 41.75 +/− 5.94 | 48.5 +/− 11.58 |
| cfh -/- | PBS | 47.00 +/− 3.67 | 45.75 +/− 5.85 |
| cfh -/- | Exemplary construct 72 | 52.5 +/− 2.90 | 39.25 +/− 2.95 |
| cfh -/- | Exemplary fusion construct 48 | 50.50 +/− 5.84 | 57.00 +/− 2.48 |
| cfh -/- | Exemplary construct 71 | 41.75 +/− 2.59 | 38.25 +/− 2.29 |

TABLE 30

Plasma transaminase levels in 4-month old female wild-type and cfh$^{-/-}$ 72 hours after single injection

| Genotype | Treatment | ALT (GPT) (U/L) | AST GOT (U/L) |
|---|---|---|---|
| Wildtype | none | 45.22 +/− 9.02 | 112.63 +/− 19.64 |
| cfh -/- | Exemplary fusion construct 64 | 40.45 +/− 6.81 | 219.25 +/− 38.20 |
| cfh -/- | PBS | 51.98 +/− 11.10 | 97.95 +/− 2.38 |
| cfh -/- | Exemplary construct 72 | 34.00 +/− 3.75 | 185.05 +/− 38.46 |
| cfh -/- | Exemplary fusion construct 48 | 62.68 +/− 14.84 | 120.10 +/− 32.37 |
| cfh -/- | Exemplary construct 71 | 43.05 +/− 7.31 | 267.25 +/− 50.62 |

TABLE 31

Evaluation of serum C3 levels in 4-5 month old male cfh$^{-/-}$ mice

| Genotype | Treatment | day 3 24 h after 2nd injection (μg/ml) | day 9 1 week after 2nd injection (μg/ml) | (μg/ml) |
|---|---|---|---|---|
| cfh -/- | Exemplary fusion construct 64 | 35.00 +/− 2 | 46.00 +/− 2.65 | 47.33 +/− 9.24 |
| cfh -/- | Exemplary fusion construct 118 | 46.33 +/− 10.87 | 629.00 +/− 91.90 | 61.00 +/− 17.04 |
| cfh -/- | Exemplary fusion construct 116 | 42.33 +/− 0.67 | 203.00 +/− 30.92 | 86.67 +/− 16.02 |
| cfh -/- | Exemplary construct 58 | 30.00 +/− 3.61 | 23.00 +/− 1.00 | 36.00 +/− 2.00 |

TABLE 32

Plasma transaminase levels in 4-5 month old male cfh$^{-/-}$ mice 1 week after 2$^{nd}$ injection

| Genotype | Treatment | ALT (GPT) (U/L) | AST (GOT) (U/L) |
|---|---|---|---|
| cfh -/- | Exemplary fusion construct 64 | 48.73 +/− 4.56 | 140.33 +/− 13.45 |
| cfh -/- | Exemplary fusion construct 118 | 63.8.3 +/− 10.73 | 205.67 +/− 65.74 |
| cfh -/- | Exemplary fusion construct 116 | 56.13 +/− 2.56 | 270.67 +/− 67.36 |
| cfh -/- | Exemplary construct 58 | 42.80 +/− 1.54 | 184.07 +/− 96.14 |

Example 14: Evaluation of C3d mAb and Complement Inhibitors in a Middle Cerebral Artery Occlusion (MCAO) Model Study Design Ninety-eight male Balb/c mice 8-20 g (Charles River Laboratories, Wilmington, Mass.) were allowed free access to food and water and were housed in a room provided with filtered air at a temperature of 21+/−5° C. and 50%+/−30% relative humidity. The room was on an automatic timer for a light dark cycle of 12 hours on and 12 hours off with no twilight. Shepherd's® ¼" premium corn cob was used for bedding and 2 pieces of Neslets by Ancare and crink'l Nest™ were put in each cage. Animals were fed with Lab Diet® 5001 chow. Water was provided ad libitum. 4-5 animals were housed per cage. 9 experimental groups consisting of 8 to 10 mice each were used for this study.

Surgical Preparation

Surgeries were all performed using aseptic technique. Cefazolin (40 mg/kg; Hospira) was administered intraperitoneally (IP) before Middle Cerebral Artery Occlusion (MCAO) to prevent infections. Buprenorphine was provided subcutaneously (SC) (~0.1 mg/kg, Par Pharmaceuticals) as an analgesic, prior to MCAO. Sodium chloride hypertonicity ophthalmic ointment (Muco 128 sterile ophthalmic 5% ointment), was applied to the eyes prior to surgery.

Middle Cerebral Artery Occlusion Model

The MCAO reperfusion model, a model of acute stroke, was used for this study. Mice were anesthetized using 2-3% isoflurane with $N_2O_2$ (2:1) and maintained with a breathing tube at 1.5-2.5% isoflurane in a supine position. The middle of the neck was shaved with electric clippers and cleaned with multiple applications of Hibiclens and alcohol. Using aseptic technique, a skin incision was made over the right common carotid artery (CCA), the muscle was retracted and the CCA bifurcation was exposed. The CCA was ligated and a distal segment of the external carotid artery (ECA) was temporarily clamped. A nylon suture was then inserted through the CCA and advanced into the internal carotid artery (ICA) for a predetermined distance of 8-9 mm. Using this procedure, the silicone coated tip of the suture occludes the origin of the MCA in the brain, causing lack of blood flow in the MCA territory. The ECA clip/suture was then removed. The skin incision was closed with surgical staples and the animals were allowed to awaken from anesthesia and put back to the home cage. The animals were again anesthetized after the 60 minutes ischemic period, the wound was re-opened, and the intravascular suture was removed from the VVA. The skin wound was again closed, and the animals were monitored until they had fully awaked from anesthesia at which point they were returned to their home cage. During the times of anesthesia, a self-regulating heating pad was connected to a rectal thermometer in order to maintain the core temperature at 37° C.+/−1° C.

Sham Operation of MCAO

A sham MCAO operation was also performed. Mice were anesthetized using 2-3% isoflurane with $N_2O:O_2$ (2:1) and maintained with a breathing tube at 1.5-2.5% isoflurane in a supine position. The middle of the neck was shaved with electric clippers and cleaned with multiple applications of Hibiclens and alcohol. Using aseptic technique, a skin incision was made over the right common carotid artery (CCA), the muscle was retracted and the CCA bifurcation was exposed. The CCA, ECA, and ICA were isolated, then the skin incision was closed with surgical staples. The animals were allowed to awaken from anesthesia and put back in their home cage. During the time of anesthesia, a self-regulating heating pad connected to a rectal thermometer was used to maintain the core temperature of 37° C.+/−1° C.

Dosing

All dosing solutions were stored at 4° C. until use. The MCAO animals received PBS, C3d mAb or C3d-CR1$_{1-17}$ through an IV tail vein injection 60 minutes after reperfusion. The sham operated animals received PBS 60 minutes after the operation time.

Randomization and Blinding

Treatments were randomly assigned to each animal after the surgery by a different individual who did not perform the surgery. The treatment of the dosing solution were evenly distributed each day.

Sacrifice

Forty-eight hours after MCAO, mice were anesthetized using ketamine/xylazine mixture (~100/10 mg/kg) and perfused with ice cold heparinized PBS followed by ice cold 4% paraformaldehyde (PFA). Brains were then removed and post-fixed in 4% PFA in the refrigerator for twenty-four hours.

Tissue Preparation for Histology:

After 24 hours of 4% PFA post fixation, brains were changed to a 30% sucrose solution and kept in the refrigerator for 3 more days. Each brain was then cut into five 1 mm thick coronal sections using a mouse brain matrix (1.1, −0.9, −1.9, −2.9, compared to bregma respectively and embedded with Tissue-Tek® O.C.T. compound in standard CryoMold. The mold was then placed in a tray filled with 2-Methyl butane among dry ice. When the OCT compound was frozen, the samples were immediately sealed in Ziplock bags and stored at −80° C. until sent to a histology laboratory.

Imaging and Image Analysis

Images were captured using a digital camera fixed on a microscope using SPOT software. Volumetric analysis of the infarct area was performed using ImageJ (NIH software). The free-hand tool was used to trace the area of the un-infarcted tissue of the ipsilateral (right) hemisphere and the tissue of the contralateral (left) hemisphere. Infarct area was calculated by subtracting the un-infarcted area of the ipsilateral hemisphere from the area of the intact contralateral hemisphere. The volume of each hemisphere was then calculated by multiplying the area with section thickness (1 mm) and adding the number of sections in between each sampling (5). The infarct volume was expressed as a percentage of the intact hemispheric volume.

Data Analysis

Table 33 summarizes the proteins tested in the MCAO study.

Figure 34:
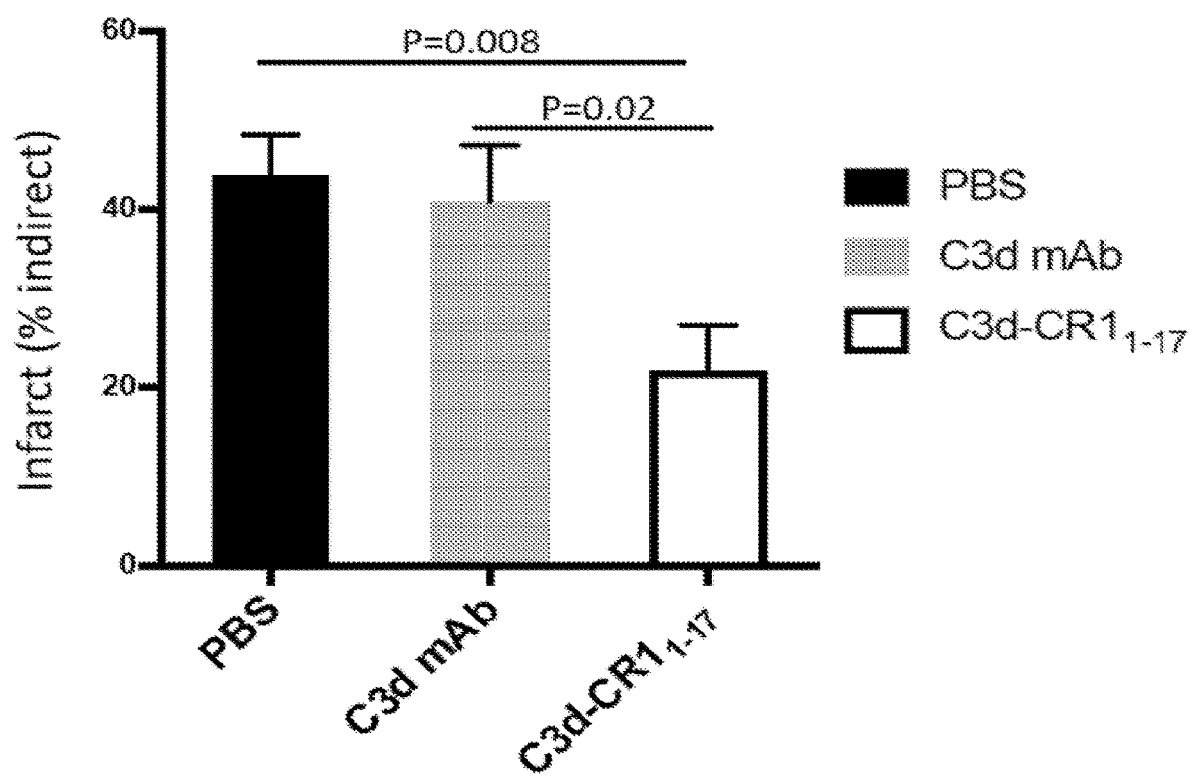
FIG. 34 shows the percent of infarct volume in Balb/c mice.

FIG. 34 shows the calculated percentage infarct area for study. All data were expressed as mean+/−standard error of the mean. Data was analyzed by one-way ANOVA.

TABLE 33

Summary of reagents tested in the MCAO Study

| Compound ID | Dose Level (mg/kg) | Dose Volume (ml/kg) |
|---|---|---|
| Exemplary construct 64 | 67 | 5 |
| Exemplary construct 58 | 24.8 | 5 |
| Vehicle | NA | 5 |

Figure 35:
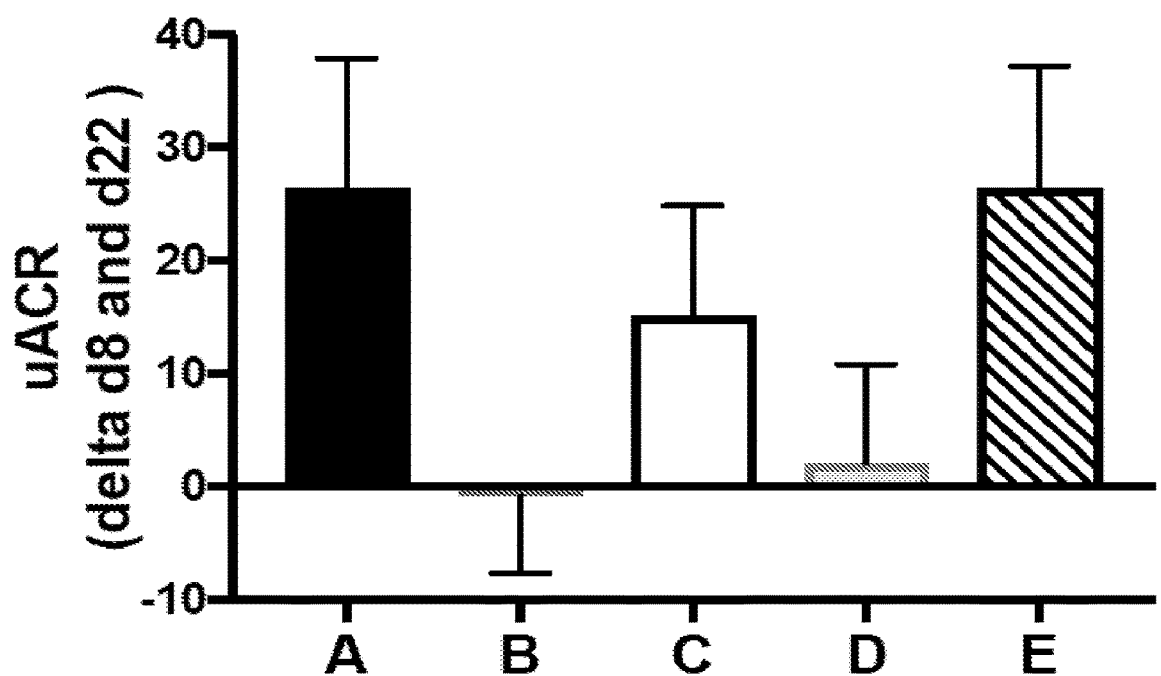
FIG. 35 shows the delta in urine albumin: creatinine ratios (uACR) in adriamycin-injured mice between days 8 and 22 of the study. Day 8 is prior to treatment and day 22 represents 12 days after dosing with complement inhibitors (after treatment).

Example 15: Effects of Complement Inhibitor Fusion Proteins on Adriamycin Induced Kidney Damage Male BALB/c OLA mice received adriamycin (11 mg/kg) intravenously via the tail vein on day 0. On day 8, mice were placed in metabolic cages and urine was collected over 16 hours. Urine samples were analyzed for albumin and creatinine using a Cobas c111 analyzer. All mice exhibited renal impairment by day 8 as determined by urine albumin:creatinine ratios (uACR). Mice were randomized into groups based on uACR. On day 10, mice received a single dose IV of either PBS (n=14) or fully murine fusion proteins C3d mAb-Crry (n=14; 50 mg/kg), C3d mAb-fH$_{1-5}$(n=13; 50 mg/kg), or non-targeted controls containing the fH$_{1-5}$ or Crry proteins. Mice were placed again in metabolic cages to collect day 22 urine over 16 hr, and urine albumin and creatinine were determined (FIG. 35).

Example 16: Study of an Exemplary C3d-Complement Modulator Protein of this Disclosure in a Patient with Progressive Complement 3 Glomerulonephritis Aim: The aim of this study is to evaluate the efficacy, safety, and tolerability of treatment with the exemplary anti-C3d antibody-complement modulator fusion protein construct in a patient with a complement mediated disease or disorder, for instance and for illustration only, progressive complement 3 (C3) glomerulonephritis.

Objectives: The primary safety objective of this study is to evaluate the safety and tolerability of treatment with the exemplary anti-C3d antibody-complement modulator fusion protein construct, for instance, for complement 3 (C3) glomerulonephritis. The primary efficacy objective is to evaluate the efficacy of treatment with the exemplary anti-C3d antibody-complement modulator fusion protein construct based on change from baseline, for example, in eGFR (MDRD, Estimated Glomerular Filtration Rate) and proteinuria. The secondary objectives of this study include assessment of: 1. Change from baseline in pharmacodynamic markers in plasma and urine, e.g., MCP-1, C3a, C5a, properdin, and sC5b-9; 2. Change from baseline in glomerular pathology based on renal biopsy; 3. Evaluation of the plasma concentrations of treatment with the exemplary anti-C3d antibody-complement modulator fusion protein construct in C3 glomerulonephritis.

A C3 glomerulonephritis patient receives treatment with a parenterally intravenously administered (e.g., intravenously, subcutaneously) exemplary anti-C3d antibody-complement modulator fusion protein of this disclosure, following the protocol detailed below. In some cases, the patient has refractory disease despite a kidney transplant and prior treatment with the broadly immunosuppressive drugs, e.g, with rituximab, cyclophosphamide, mycophenolate mofetil, tacrolimus, and steroids. In some cases, renal allograft biopsies are taken pre-dose, 2- and 7-months during therapy.

Methodology: In some cases, the patient will have biopsy proven recurrent C3GN prior to start of dosing and be deemed eligible based on the inclusion and exclusion criteria. Screening procedures will include recording of demographics, medical history, medication history, physical examination and vital signs, serum chemistry, hematology, urinalysis (including UPCR measurement), viral screening (if not performed within prior 12 weeks) and estimated glomerular filtration rate (eGFR) assessment based on serum creatinine. The baseline eGFR is, for example, about 15-25 mL/min/1.73 m$^2$ for study eligibility. On Day 1, the patient may start treatment with the exemplary anti-C3d antibody-complement modulator fusion protein construct treatment. Patients will take treatment with the exemplary anti-C3d antibody-complement modulator fusion protein construct parenterally, for an initial period of about 60-84 days. The patient will visit the study center at frequent intervals for monitoring. If the patient's clinical condition stabilizes or improves, and there are no adverse events preventing further treatment, the patient may be treated for another treatment cycle, e.g., of about 60-84 days. Treatment cycles may be repeated for a total of 4 cycles under this protocol.

At the Day 1 and post-Day 1 study visits, blood and urine samples will be collected for safety, efficacy, and pharmacokinetic measurements. Physical examinations and vital signs assessments will be performed throughout the study. Concomitant medication and adverse event assessments will be made at every study visit. If possible, a renal biopsy will be performed after an appropriate follow-up period to assess the changes in kidney histology.

Results: The patient's condition is expected to improve in response to the treatment with the exemplary C3d-complement modulator fusion protein construct of this disclosure. The improvement seen with the C3d-complement modulator fusion protein construct treatment in this patient is based on the on-treatment kidney biopsy histologic findings showing clearance of glomerular endocapillary proliferation and a marked decrease in glomerular inflammatory macrophages compared to the pre-treatment biopsy. Proteinuria drops approximately 80% with the fusion protein construct treatment.

Estimated glomerular filtration rate (eGFR) can be, for example, about 80-90 mL/min/1.73 m$^2$ 14 months prior to treatment with the exemplary C3d fusion protein construct and can deteriorate to, for example, about 30-50 mL/min/1.73 m$^2$ when treatment with the exemplary C3d fusion protein construct is started. In addition, treatment with the exemplary C3d fusion protein construct attenuates or stops the eGFR decline. After 1 month of treatment, the eGFR decline is expected to be already attenuated. Repeat biopsies show resolution of glomerular endocapillary hypercellularity and reduction in glomerular macrophages. Thus, treatment with the exemplary C3d fusion protein construct stabilizes eGFR and reduced glomerular inflammation.

Example 17: Study of Efficacy of an Exemplary Fusion Protein Construct of this Disclosure in Treating Renal Ischemic/Reperfusion Ischemia-Reperfusion (I/R) injury in kidney at body temperature has relevance in several clinical conditions, including hypovolemic shock, renal artery occlusion and cross-clamping procedures.

Kidney ischemia-reperfusion (I/R) is an important cause of acute renal failure, associated with a mortality rate of up to 50% (Levy et al., *JAMA* 275:1489-94, 1996; Thadhani et al., N. Engl. J. Med. 334:1448-60, 1996). Post-transplant renal failure is a common and threatening complication after renal transplantation (Nicholson et al., *Kidney Int.* 58:2585-91, 2000). Effective treatment for renal FR injury is currently not available and hemodialysis is the only treatment available. The pathophysiology of renal FR injury is complicated. Recent studies have shown that the lectin pathway of complement activation may have an important role in the pathogenesis of renal I/R injury (deVries et al., *Am. J. Path.* 165:1677-88, 2004).

Renal function is assessed at 24 and 48 hours after reperfusion in a patient administered an exemplary fusion protein construct of this disclosure. Blood creatinine measurement is determined by mass spectrometry, which provides a reproducible index of renal function. The patient displays a significant reduction in the amount of blood urea at 24 and 48 hours, indicating a protective functional effect from renal damage. Overall, increased blood urea is seen in both at 24 and 48 hours following the surgical procedure and ischemic insult.

Example 18: Study of Efficacy of an Exemplary Fusion Protein Construct of this Disclosure in Treating Macular Degeneration Age-related macular degeneration (AMD) is the leading cause of blindness after age 55 in the industrialized world. AMD occurs in two major forms: neovascular (wet) AMD and atrophic (dry) AMD. The neovascular (wet) form accounts for 90% of severe visual loss associated with AMD, even though only "20% of individuals with AMD develop the wet form. Clinical hallmarks of AMD include multiple drusen, geographic atrophy, and choroidal neovascularization (CNV). In December 2004, the FDA approved Macugen (pegaptanib), a new class of ophthalmic drugs to specifically target and block the effects of vascular endothelial growth factor (VEGF), for treatment of the wet (neovascular) form of AMD (Ng et al., *Nat Rev. Drug Discov* 5:123-32 (2006)). Although Macugen represents a promising new therapeutic option for a subgroup of AMD patients, there remains a pressing need to develop additional treatments for this complex disease. Multiple, independent lines of investigation implicate a central role for complement activation in the pathogenesis of AMD. The pathogenesis of choroidal neovascularization (CNV), the most serious form of AMD, may involve activation of complement pathways.

A group of patients suffering from AMD are administered, intraocularly or parenterally, an exemplary fusion protein construct of this disclosure. At various time points following the administration, choroidal neovascularization is assessed. In patients administered the exemplary fusion protein construct of the disclosure, a 20% to 100% reduction in CNV area is observed, compared to patients administered a sham control.

Example 19: Study of Efficacy of an Exemplary Fusion Protein Construct of this Disclosure in Treating Atypical Hemolytic Uremic Syndrome (aHUS)

Atypical hemolytic uremic syndrome (aHUS) is characterized by hemolytic anemia, thrombocytopenia, and renal failure caused by platelet thrombi in the microcirculation of the kidney and other organs. aHUS is associated with defective complement regulation and can be either sporadic or familial. aHUS is associated with mutations in genes coding for complement activation, including complement factor H, membrane cofactor B and factor I, and well as complement factor H-related 1 (CFHR1) and complement factor H-related 3 (CFHR3). Zipfel, P. F., et al., *PloS Genetics* 3(3):e41 (2007).

The effect of the exemplary fusion protein construct of this disclosure to treat aHUS is determined by obtaining and lysing red blood cells from aHUS patients treated with the exemplary fusion protein construct. It is observed that treatment with the exemplary fusion protein construct is effective in blocking lysis of red blood cells in the patients suffering from aHUS, compared to treatment with a sham control.

Example 20: PEPperMAP® Linear Epitope Mapping of 5 Mouse IgG1 Antibodies Against C3dg_Extended The PEPperMAP® Linear Epitope Mappings of mouse IgG1 antibodies were performed against C3dg_extended translated into linear overlapping 15 amino acid peptides with a peptide-peptide overlap of 14 amino acids as well as against 15 additional peptides. Pre-staining of a C3dg peptide microarray was performed with secondary goat anti-mouse IgG (H+L) DyLight680 antibody (1:5000) to determine background interactions with the linear C3dg peptides that could interfere with the main assays. The C3dg peptide microarrays were incubated with exemplary anti-C3d mouse IgG1 antibodies 3d29, 3d8b, 3d9a at concentrations of 1 µg/ml, 10 µg/ml or 100 µg/ml in incubation buffer (e.g., washing buffer with 10% blocking buffer) followed by staining with secondary goat anti-mouse IgG (H+L) DyLight680 antibody (1:5000) and control mouse monoclonal anti-HA (12CA5) DyLight800 antibody (1:2000). The CI samples were used as negative controls. The incubation step was performed for 16 hours at 4° C. with shaking at 140 rpm. The staining with secondary antibody and control antibody was performed for 45 min in incubation buffer at room temperature (RT). Read-out with a LI-COR Odyssey Imaging System was done at scanning intensities of 7/7 (red/green). The additional HA peptides framing the peptide microarrays were subsequently stained as internal quality control to confirm the assay quality and the peptide microarray integrity. Table 34 describes the materials and methods in more detail.

TABLE 34

Materials and Methods

| | |
|---|---|
| Microarray Content: | The sequence of C3dg_extended was elongated with neutral GSGSGSG linkers (SEQ ID NO: 297) at the C- and N- terminus to avoid truncated peptides and translated into 15 amino acid linear peptides with a peptide-peptide overlap of 14 amino acids. The C3dg peptide microarrays were further complemented by 15 additional peptides and contained 375 different peptides printed in duplicate (750 peptide spots) as well as additional HA (YPYDVPDYAG (SEQ ID NO: 298), 80 spots) control peptides. |
| Samples: | Mouse anti-C3d IgG1 antibodies 3d29, 3d8b, 3d9a, CI-00008, and CI-00009 (CI samples are negative controls) |
| Washing Buffer: | PBS, pH 7.4 with 0.05% Tween 20 (3 × 1 min after each assay) |
| Blocking Buffer: | Rockland blocking buffer MB-070 (30 min before the first assay) |
| Incubation Buffer: | Washing buffer with 10% blocking buffer |
| Assay Conditions: | Antibody concentrations of 1 µg/ml, 10 µg/ml and 100 µg/ml in incubation buffer; incubation for 16 h at 4° C. and shaking at 140 rpm. |
| Secondary Antibody: | Goat anti-mouse IgG (H + L) DyLight680 (1:5000); 45 min staining in incubation buffer at RT |
| Control Antibody: | Mouse monoclonal anti-HA (12CA5) DyLight800 (1:2000); 45 min staining in incubation buffer at RT |
| Scanner: | LI-COR Odyssey Imaging System; scanning offset 0.65 mm, resolution 21 µm, scanning intensities of 7/7 (red = 680 nm/green = 800 nm). |

Quantification of spot intensities and peptide annotation were based on the 16-bit gray scale tiff files at scanning intensities of 7/7 that exhibited a higher dynamic range than the 24-bit colorized tiff files. Further, microarray image analyses, quantification of spot intensities and peptide annotation were performed with PepSlide® Analyzer. In short, the software algorithm breaks down fluorescence intensities of each spot into raw, foreground and background signal, and calculates average median foreground intensities and spot-to-spot deviations of spot duplicates. An intensity map was generated, based on the averaged median foreground intensities, and interactions in the peptide map highlighted by an intensity color code with red for high and white for low spot intensities. A maximum spot-to-spot deviation of 40% was found to be acceptable (otherwise the corresponding intensity value was zeroed).

Figure 21:
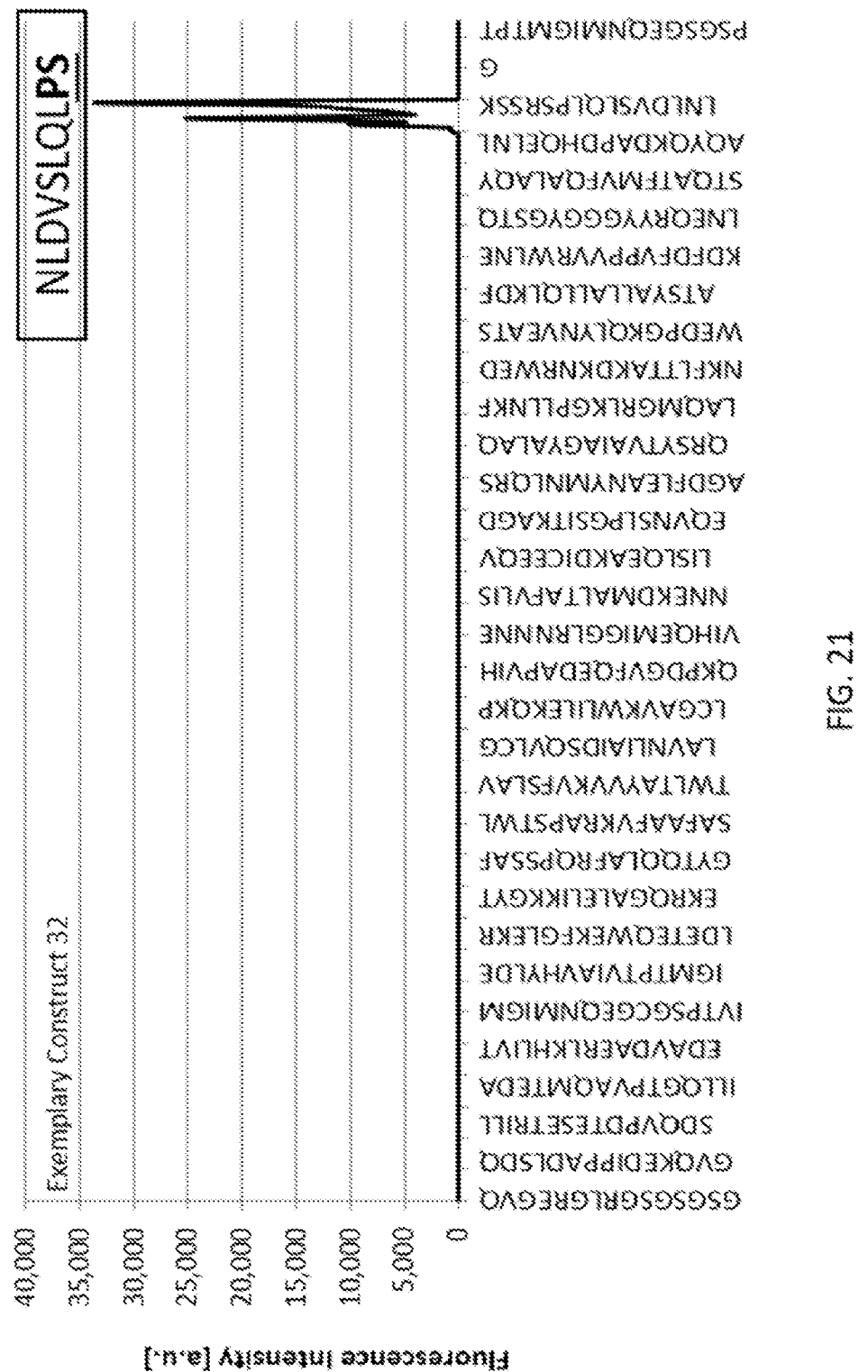
FIG. 21 illustrates recognition of an epitope on the C-terminus of C3dg by exemplary anti-C3d antibody 3d29.
Figure 22:
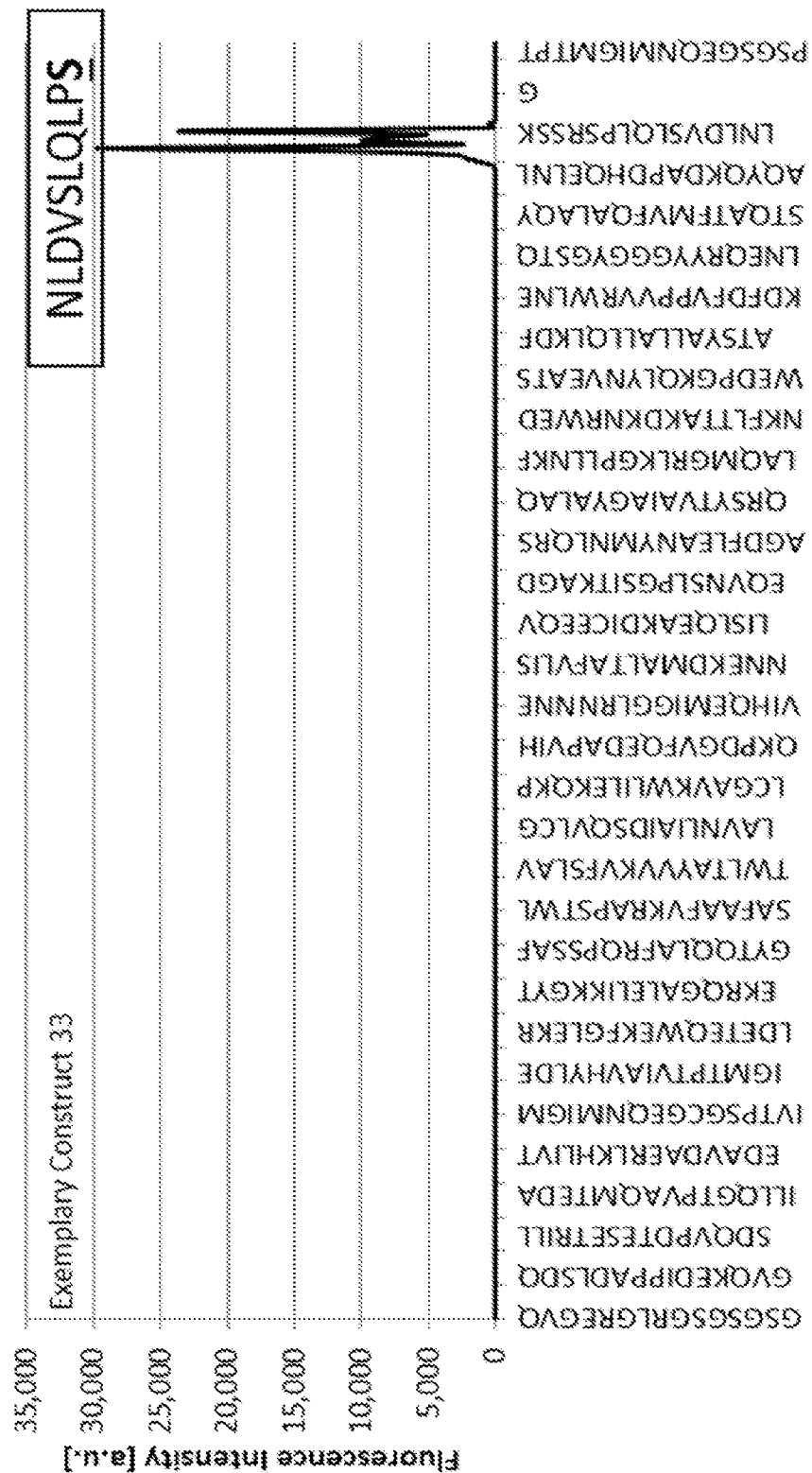
FIG. 22 illustrates recognition of an epitope on the C-terminus of C3dg by exemplary anti-C3d antibody 3d8b.
Figure 23:
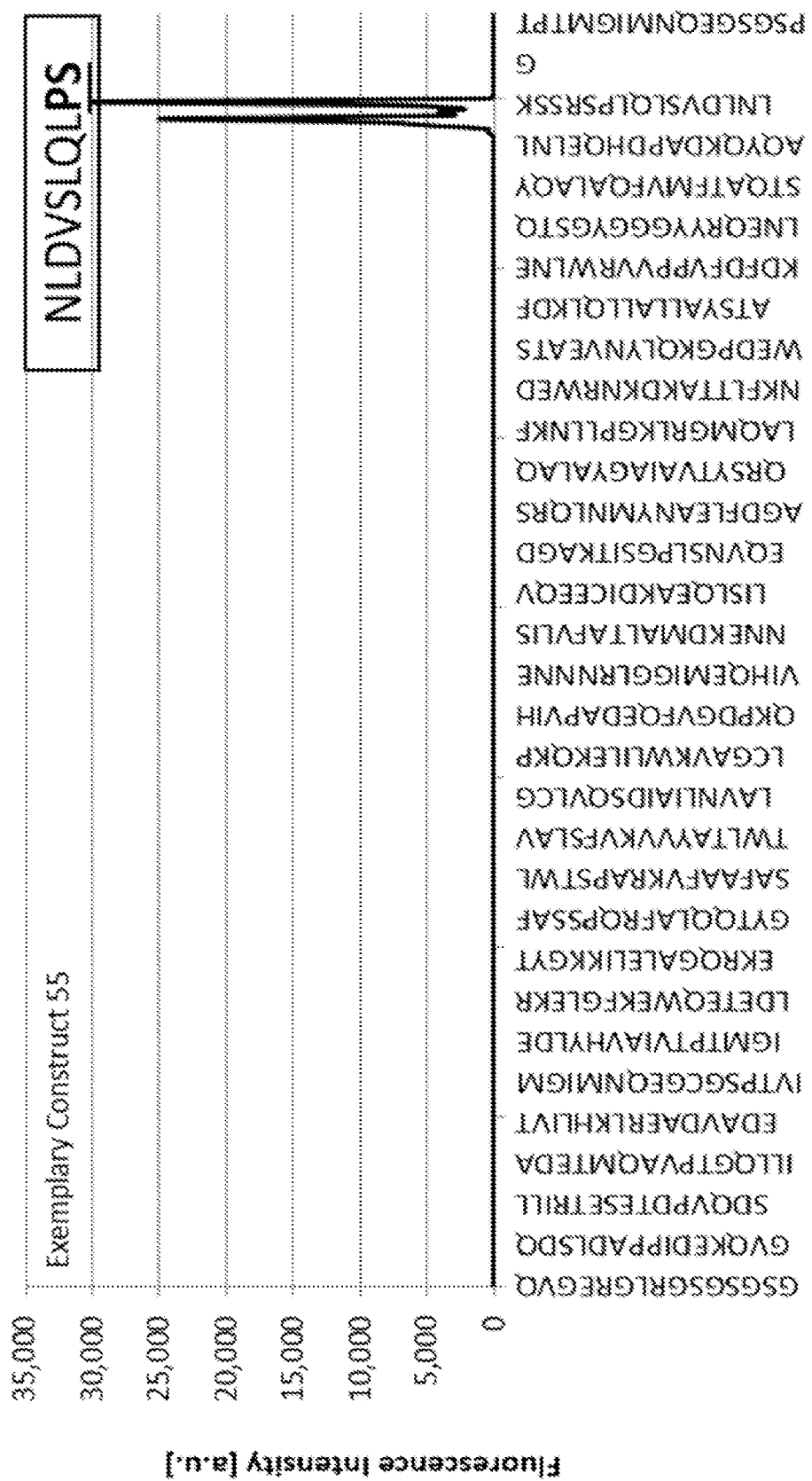
Figure 24:
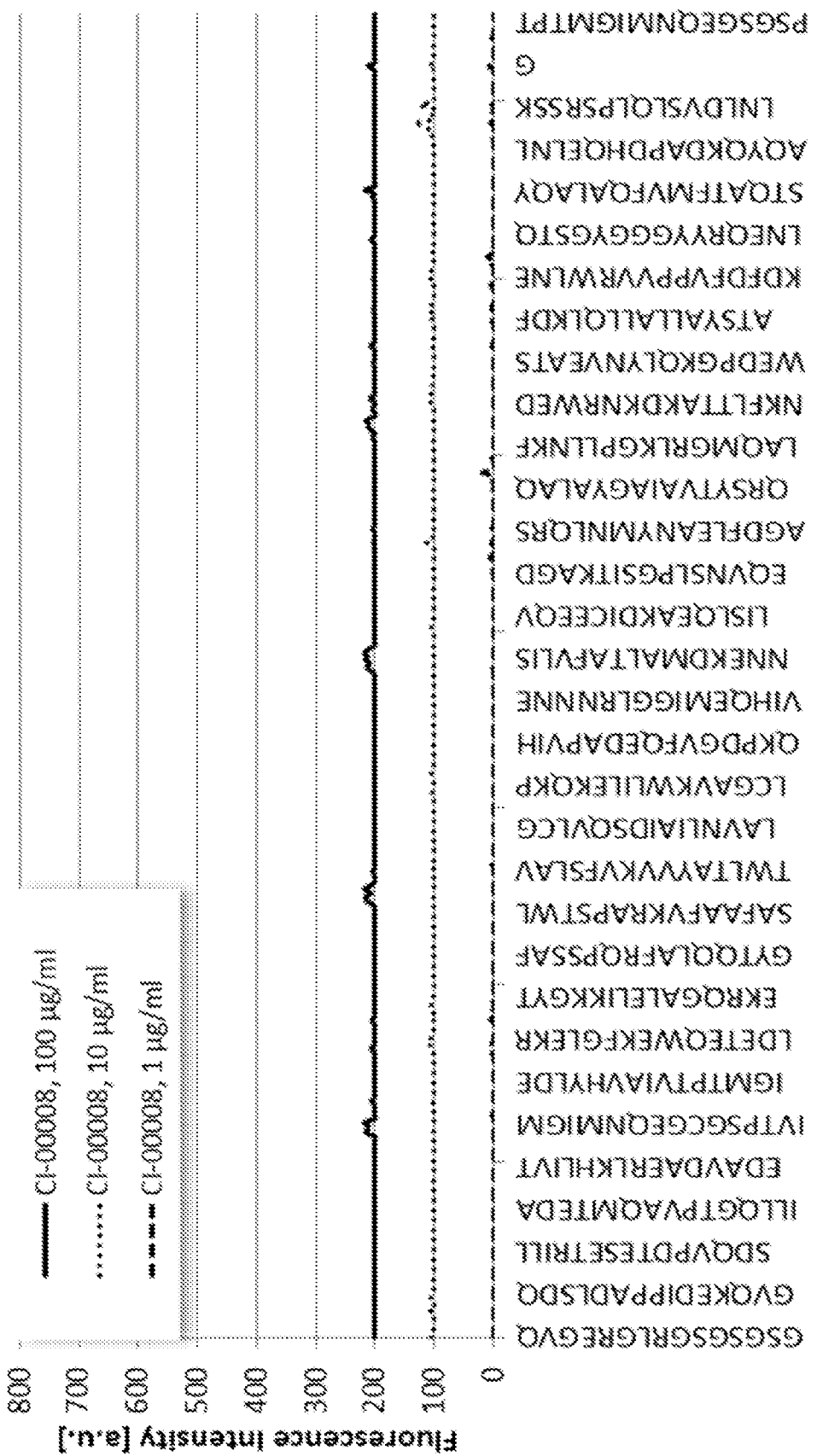
FIG. 24 illustrates epitope mapping using negative control anti-C3d antibody, that did not bind a linear epitope, tested at various concentrations.
Figure 25:
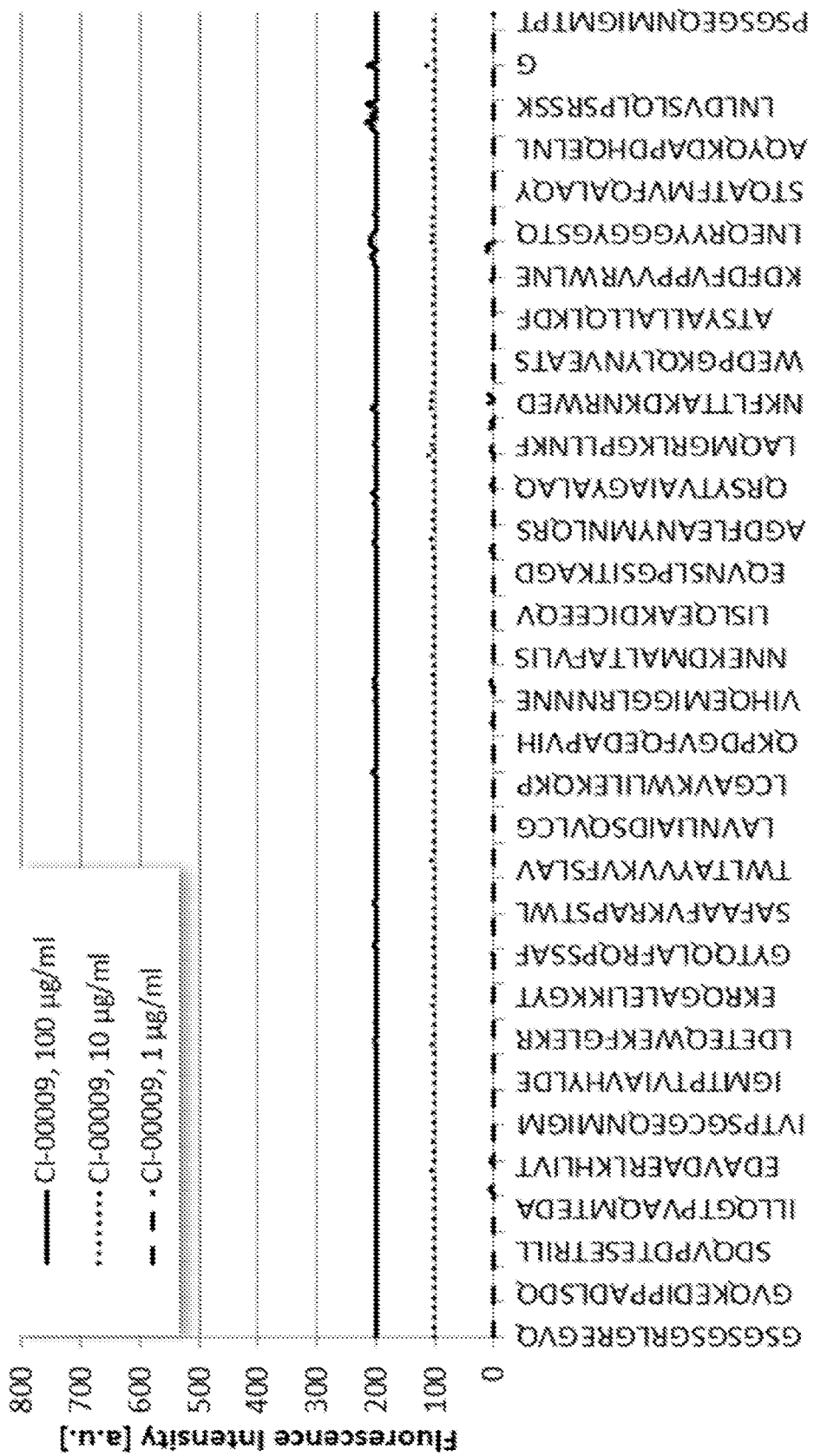
FIG. 25 illustrates epitope mapping using a negative control anti-C4d antibody, tested at various concentrations.
Figure 27A:
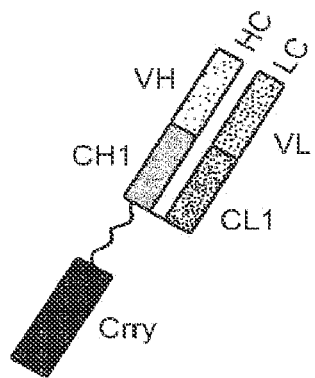
FIGS. 27A-27E illustrates exemplary designs for anti-C3d (3d29)-complement modulator (CR1 or factor H) fusion protein constructs of this disclosure.
Figure 27B:
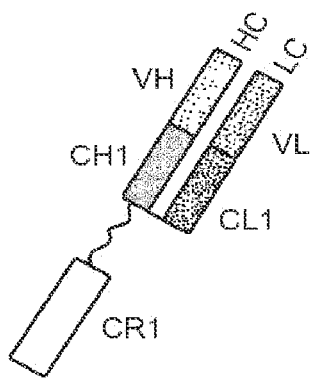
Figure 27C:
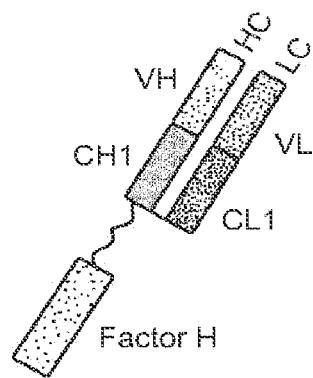
Figure 27D:
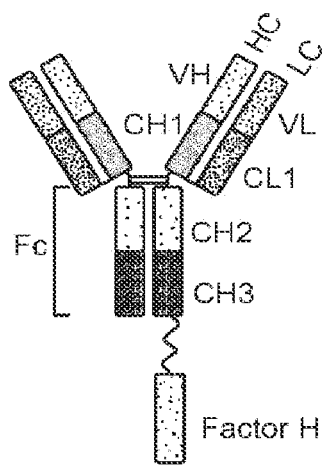
Figure 27E:
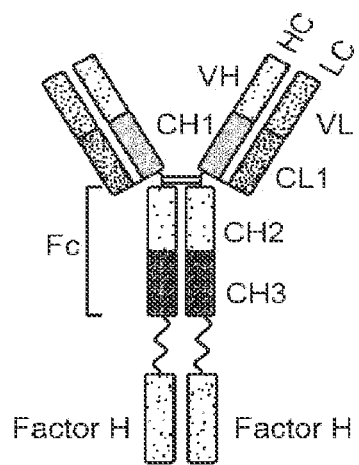
Figure 28A:
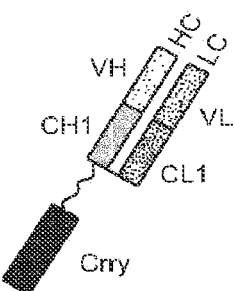
Figure 28B:
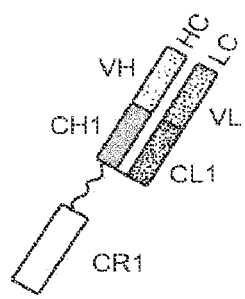
Figure 28C:
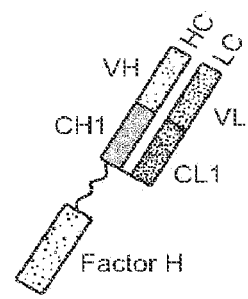
Figure 28D:
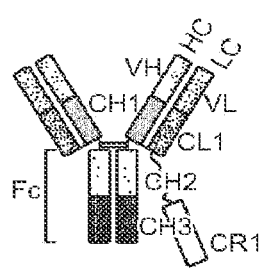
Figure 28E:
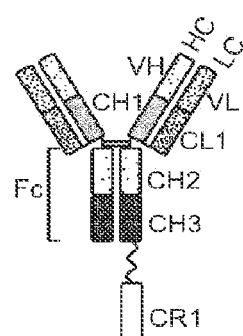
Figure 28F:
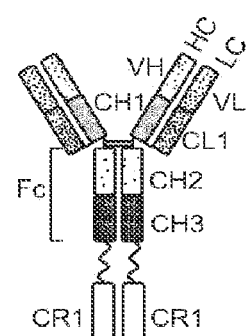
Figure 28G:
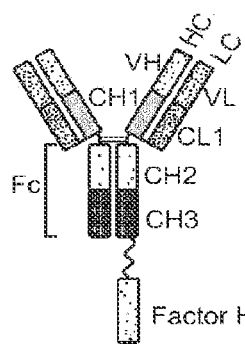
Figure 28H:
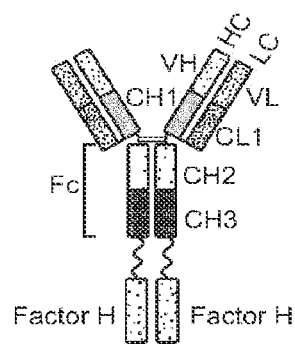
Figure 29C:
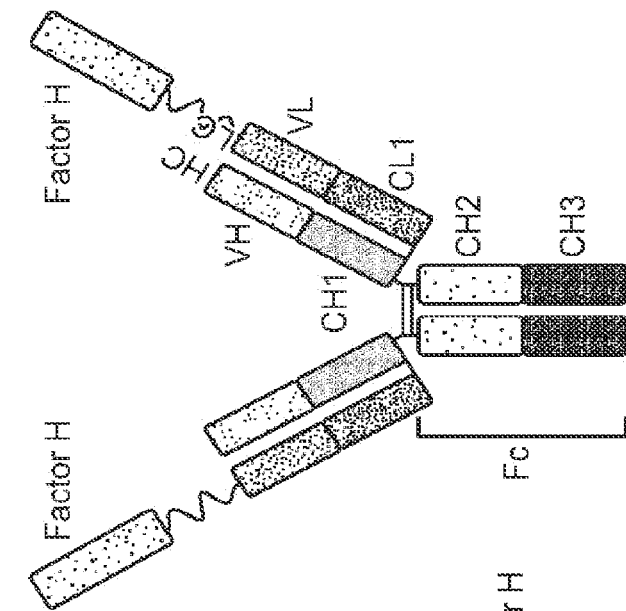
FIGS. 29A-29C illustrates exemplary designs for anti-C3d (3d8b)-complement modulator (factor H) fusion protein constructs of this disclosure.
Figure 29B:
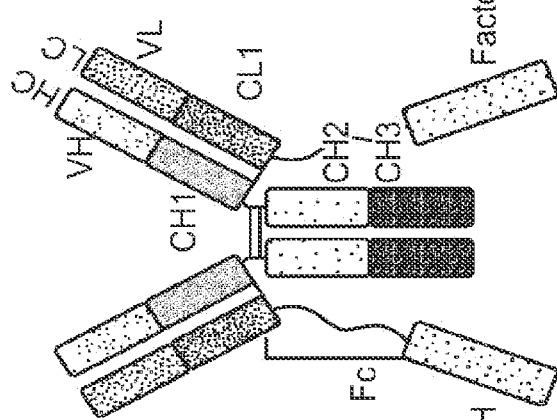
Figure 29A:
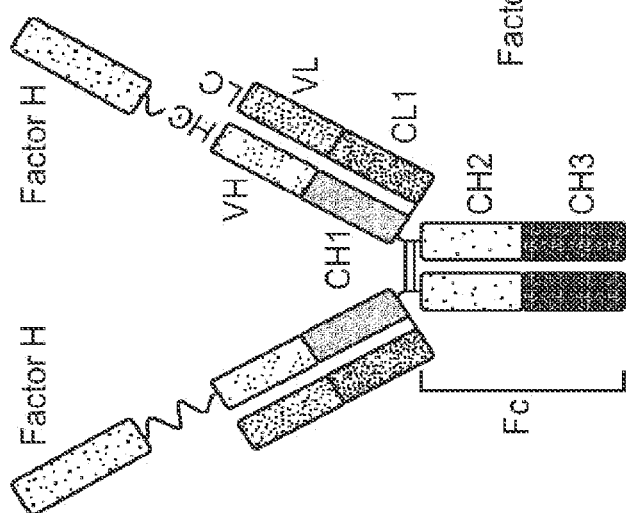

In addition, the averaged spot intensities of the assays with the mouse antibodies against the antigen sequence from the N- to the C-terminus of C3dg_extended were plotted to visualize overall spot intensities and signal-to-noise ratios. The intensity plots were correlated with peptide and intensity maps as well as with visual inspection of the microarray scans to identify epitopes of the mouse antibody samples. If it was not clear whether a certain amino acid contributed to antibody binding, the corresponding letters of such amino acids were underlined, as illustrated in FIGS. 21-23. In some cases, the baselines of the intensity plots were leveled. FIGS. 24-25 illustrate epitope mapping studies that were carried out with negative control anti-C3d or anti-C4d antibodies at 1, 10 and 100 µg/mL, which did not recognize the epitopes recognized by the exemplary anti-C3d antibodies 3d9a, 3d29, or 3d8b (as shown by the peaks in FIGS. 21-23).

Pre-staining of a C3dg peptide microarray with secondary goat anti-mouse IgG (H+L) DyLight680 antibody did not show any background interaction with the linear C3dg_extended peptides that could interfere with the main assays. Mouse anti-C3d IgG1 antibodies 3d29, 3d8b and 3d9a showed very strong monoclonal antibody responses with high spot intensities and signal-to-noise ratios against adjacent peptides with similar consensus motifs NLDVSLQLPS (SEQ ID NO: 299), NLDVSLQLPS (SEQ ID NO: 299) and NLDVSLQLPS (SEQ ID NO: 299), as illustrated in FIGS. 21-23. The 15 additional peptides did not react with the mouse IgG1 antibodies. Specifically, when the C3dg peptide microarray was incubated with 1 µg/ml of either the mouse anti-C3d IgG1 antibody 3d29 or the mouse anti-C3d. IgG1 antibody 3d9a, very strong monoclonal antibody responses with high signal-to-noise ratio against adjacent peptides with the consensus motif NLDVSLQLPS (SEQ ID NO: 299) were observed, as illustrated in FIG. 21 and FIG. 23, respectively. Similarly, a very strong monoclonal antibody response with high signal-to-noise ratio against adjacent peptides with the consensus motif NLDVSLQLPS (SEQ ID NO: 299) was observed when the C3dg peptide microarray was incubated with the mouse anti-C3d IgG1 antibody 3d8b, at a concentration of 1 µg/ml, as illustrated in FIG. 22. All the data were obtained by a read-out at scanning intensities of 7/7 (red/green) after the C3dg peptide microarray was incubated with a mouse IgG1 antibody followed by staining with secondary and control antibodies. The underlined amino acids correspond to residues for which contribution to antibody binding was not clear. For all FIGS. 21-23, the staining of HA control peptides is shown in the control staining boxes in FIGS. 21-23). Further, PEPperMAP® Epitope Substitution Scans can be used to investigate proposed epitopes by, for example, underlying wild type peptides with an exchange of all amino acid positions with the 20 main amino acids.

TABLE 35

Exemplary protein table

| Exemplary protein constructs | Polypeptide sequence of the heavy chain (HC), variable domain heavy (VH) | Polypeptide sequence of the light chain (LC) or variable domain light (VL) |
|---|---|---|
| Exemplary anti-C3d construct 32 | SEQ ID No. 58 | SEQ ID No. 59 |
| Exemplary anti-C3d construct 33 | SEQ ID No. 73 | SEQ ID No. 68 |
| Exemplary anti-C3d construct 34 | SEQ ID No. 288 | SEQ ID No. 287 |
| Exemplary anti-C3d construct 35 | SEQ ID No. 60 | SEQ ID No. 59 |
| Exemplary anti-C3d construct 49 | SEQ ID No. 58 | SEQ ID No. 68 |
| Exemplary anti-C3d construct 53 | SEQ ID No. 62 | SEQ ID No. 59 |
| Exemplary anti-C3d construct 54 | SEQ ID No. 67 | SEQ ID No. 68 |
| Exemplary anti-C3d construct 55 | SEQ ID No. 288 | SEQ ID No. 287 |
| Exemplary anti-C3d construct 56 (Fab) | SEQ ID No. 288 | SEQ ID No. 287 |
| Exemplary anti-C3d construct 58 | SEQ ID No. 73 | SEQ ID No. 68 |
| Exemplary anti-C3d construct 73 | SEQ ID No. 73 | SEQ ID No. 68 |
| Exemplary anti-C3d construct 74 | SEQ ID No. 249 | SEQ ID No. 258 |
| Exemplary anti-C3d construct 75 | SEQ ID No. 252 | SEQ ID No. 258 |
| Exemplary anti-C3d construct 76 | SEQ ID No. 250 | SEQ ID No. 258 |
| Exemplary anti-C3d construct 77 | SEQ ID No. 253 | SEQ ID No. 258 |
| Exemplary anti-C3d construct 78 | SEQ ID No. 251 | SEQ ID No. 258 |
| Exemplary anti-C3d construct 79 | SEQ ID No. 254 | SEQ ID No. 258 |
| Exemplary anti-C3d construct 86 | SEQ ID No. 280 | SEQ ID No. 279 |
| Exemplary anti-C3d construct 87 | SEQ ID No. 281 | SEQ ID No.279 |
| Exemplary anti-C3d construct 93 | SEQ ID No. 282 | SEQ ID No. 279 |
| Exemplary C2 construct 35 | SEQ ID No. 98 | SEQ ID No. 45 |

TABLE 35-continued

Exemplary protein table

| Exemplary protein constructs | Polypeptide sequence of the heavy chain (HC), variable domain heavy (VH) | Polypeptide sequence of the light chain (LC) or variable domain light (VL) |
|---|---|---|
| Exemplary C2 construct 36 | SEQ ID No. 98 | SEQ ID No. 266 |
| Exemplary C2 construct 37 | SEQ ID No. 261 | SEQ ID No. 45 |
| Exemplary C2 construct 38 | SEQ ID No. 261 | SEQ ID No. 266 |
| Exemplary C2 construct 39 | SEQ ID No. 261 | SEQ ID No, 267 |
| Exemplary C2 construct 40 | SEQ ID No. 261 | SEQ ID No. 268 |
| Exemplary C2 construct 41 | SEQ ID No. 261 | SEQ ID No. 269 |
| Exemplary C2 construct 42 | SEQ ID No. 262 | SEQ ID No. 266 |
| Exemplary C2 construct 43 | SEQ ID No. 262 | SEQ ID No. 267 |
| Exemplary C2 construct 44 | SEQ ID No. 262 | SEQ ID No. 268 |
| Exemplary C2 construct 45 | SEQ ID No. 262 | SEQ ID No. 269 |
| Exemplary C2 construct 46 | SEQ ID No. 263 | SEQ ID No. 266 |
| Exemplary C2 construct 47 | SEQ ID No. 263 | SEQ ID No. 267 |
| Exemplary C2 construct 48 | SEQ ID No. 263 | SEQ ID No. 268 |
| Exemplary C2 construct 49 | SEQ ID No. 263 | SEQ ID No. 269 |
| Exemplary C2 construct 50 | SEQ ID No. 264 | SEQ ID No. 266 |
| Exemplary C2 construct 51 | SEQ ID No. 264 | SEQ ID No. 267 |
| Exemplary C2 construct 52 | SEQ ID No. 264 | SEQ ID No. 268 |
| Exemplary C2 construct 53 | SEQ ID No. 264 | SEQ ID No. 269 |
| Exemplary C2 construct 54 | SEQ ID No. 265 | SEQ ID No. 266 |
| Exemplary C2 construct 55 | SEQ ID No. 265 | SEQ ID No. 267 |
| Exemplary C2 construct 56 | SEQ ID No. 265 | SEQ ID No. 268 |
| Exemplary C2 construct 57 | SEQ ID No. 265 | SEQ ID No. 269 |
| Exemplary construct 70 | SEQ ID No. 41 | |
| Exemplary construct 71 | SEQ ID No. 72 | |
| Exemplary construct 72 | SEQ ID No. 42 | |

TABLE 36

SEQUENCE TABLE

| SEQ ID NO: | DESCRIPTION | SEQUENCE |
|---|---|---|
| 1 | MCP/CD46 | >sp\|P15529\|MCP_HUMAN Membrane cofactor protein OS = Homo sapiens OX = 9606 GN = CD46 PE = 1 SV = 3 MEPPGRRECPFPSWRFPGLLLAAMVLILYSFSDACEEPPTFEAMELIGKPK PYYEIGERVDYKCKKGYFYIPPLATHTICDRNHTWLPVSDDACYRETCPYI RDPLNGQAVPANGTYEFGYQMHFICNEGYYLIGEEILYCELKGSVAIWSGK PPICEKVLCTPPPKIKNGYETFSEVEVFEYLDAVTYSCDPAPGPDPFSLIG ESTIYCGDNSVWSRAAPECKVVKCRFPVVENGKQISGFGKKFYYKATVMFE CDKGFYLDGSDTIVCDSNSTWDPPVPKCLKVLPPSSTKPPALSHSVSTSST TKSPASSASGPRPTYKPPVSNYPGYPKPEEGILDSLDVWVIAVIVIAIVVG VAVICVVPYRYLQRRKKKGTYLTDETHREVKFTSL |
| 2 | DAF | >sp\|P08174\|DAF_HUMAN Complement decay-accelerating factor OS = Homo sapiens OX = 9606 GN = CD55 PE = 1 SV = 4 MTVARPSVPAALPLLGELPRLLLLVLLCLPAVWGDCGLPPDVPNAQPALEG RTSFPEDTVITYKCEESFVKIPGEKDSVICLKGSQWSDIEEFCNRSCEVPT RLNSASLKQPYITQNYFPVGTVVEYECRPGYRREPSLSPKLTCLQNLKWST AVEFCKKKSCPNPGEIRNGQIDVPGGILFGATISFSCNTGYKLFGSTSSFC LISGSSVQWSDPLPECREIYCPAPPQIDNGIIQGERDHYGYRQSVTYACNK GFTMIGEHSTYCTVNNDEGEWSGPPPECRGKSLTSKVPPTVQKPTTVNVPT TEVSPTSQKTTTKIIIPNAQATRSTPVSRTTKHFHETTPNKGSGTTSGTTR LLSGHTCFTLTGLLGTLVTMGLLT |
| 3 | DAF1_mouse | >sp\|Q61475\|DAF1_MOUSE Complement decay-accelerating factor, GPI-anchored OS = Mus musculus OX = 10090 GN = Cd55 PE = 1 SV = 2 MIRGRAPRTRPSPPPPLLPLLSLSLLLLSPTVRGDCGPRPDIPNARPILGR HSKFAEQSKVAYSCNNGFKQVPDKSNIVVCLENGQWSSHETFCEKSCVAPE RLSFASLKKEYLNMNFFPVGTIVEYECRPGFRKQPPLPGKATCLEDLVWSP VAQFCKKKSCPNPKDLDNGHINIPTGILFGSEINFSCNPGYRLVGVSSTFC SVTGNTVDWDDEFPVCTEIHCPEPPKINNGIMRGESDSYTYSQVVTYSCDK GFILVGNASTYCTVSKSDVGQWSSPPPRCIEKSKVPTKKPTINVPSTGTPS TPQKPTTESVPNPGDQPTPQKPSTVKVSATQHVPVTKTTVRHPIRTSTDKG EPNTGGDRYIYGHTCLITLTVLHVMLSLIGYLT |

TABLE 36-continued

SEQUENCE TABLE

| SEQ ID NO: | DESCRIPTION | SEQUENCE |
| --- | --- | --- |
| 4 | CD59 | >sp\|P13987\|CD59_HUMAN CD59 glycoprotein OS = Homo sapiens OX = 9606 GR = CD59 PE = 1 SV = 1<br>MGIQGGSVLFGLLLVLAVFCHSGHSLQCYNCPNPTADCKTAVNCSSDFDAC<br>LITKAGLQVYNKCWKFEHCNFNDVTTRLRENELTYYCCKKDLONFNEQLEN<br>GGTSLSEKTVLLLVTPFLAAAWSLHP |
| 5 | CD59_mouse isoform A | >sp\|O55186\|CD59A_MOUSE CD59A glycoprotein OS = Mus musculus OX = 10090 GN = Cd59a PE = 2 SV = 1<br>MRAQRGLILLLLLLAVFCSTAVSLTCYHCFQPVVSSCNMNSTCSPDQDSCL<br>YAVAGMQVYQRCWKQSDCHGEIIMDQLEETKLKFRCCQFNLCNKSDGSLGK<br>TPLLGTSVLVAILNLCFLSHL |
| 6 | CD59_mouse isoform B | >sp\|P58019\|CD59B_MOUSE CD59B glycoprotein OS = Mus musculus OX = 10090 GN = Cd59b PE = 2 SV = 2<br>MRAQRGLILLLLLLAVFCSTAVSLKCYNCLDPVSSCKINTTSPNLDSCLY<br>AVAGRQVYWCWKLSDCNSNYIMSRLDVAGIQSKCCQWDLCNKNLDGLEEP<br>NNAETSSLRKTALLGTSVLVAILKFCF |
| 7 | Crry | >sp\|Q64735.1\|CR1L_MOUSE Complement component receptor 1-like protein<br>MEVSSRSSEPLDPVWLLVAFGRGGVKLEVLLLFLLPFTLGELRGGLGKHGH<br>TVHREPAV<br>NRICADSKRWSGLPVSAQRPFPMGHCPAPSQLPSARPINLTDESMFPIGTY<br>LLYECLPGYIKRQPSITCKQDSTWTSAEDKCIRKQCKTPSDPENGIVHVHT<br>GIQPFGSRINYTCNQGYRLIGSSSAVCVITDQSVDWDTEAPICEWIPCEIPP<br>GIPNGDFFSSTREDFHYGMVVTYRCNTDARGKALFNLVGEPSLYCTSNDGE<br>IGVWSGPPPQCIELNKCTPPPYVENAVMLSENRSLFSLRDIVEFRCHPGFI<br>MKGASSVHCQSLNKWEPELPSCFKGVICRLPQEMSGFQKGLGMKKEYYYGE<br>NVTLECEDGYTLEGSSQSQCQSDGSWNPLLAKCVSRSTSGLIVGIFIGIIV<br>FILVIIVFIWMILKYKKRNTTDEKYKEVGIHLNYKEDSCVRLQSLLTSQEN<br>SSTTSPARNSLTQEVS |
| 8 | CR1 | >sp\|P17927\|CR1_HUMAN Complement receptor type 1<br>OS = Homo sapiens OX = 9606 GN = CR1 PE = 1 SV = 3<br>MGASSPRSPEPVGPPAPGLPFCCGGSLLAVVVLLALPVAWGQCNAPEWLPF<br>ARPTNLTDEFEFFIGTYLNYECRPGYSGRPFSTICLKNSVWTGAKDRCRRK<br>SCRNPPDPVNGMVHVIKGIQFGSQIKYSCTKGYRLIGSSSATCIISGDTVI<br>WDNETPICDRIPCGLPPTITNGDFISTNRENFHYGSVVTYRCNPGSGGRKV<br>FELVGEPSIYCTSNDDQVGIWSGPAPQCIIPNKCTPPNVENGILVSDNRSL<br>FSLNEVVEFRCQPGFVMKGPRRVKCQALNKWEPELPSCSRVCQPPPDVLHA<br>ERTQRDKDNESPGQEVFYSCEPGYDLRGAASMRCTPQGDWSPAAPTCEVKS<br>CDDFMGQLLNGRVLFPVNLQLGAKVDFVCDEGFQLKGSSASYCVLAGMESL<br>WNSSVPVCEQIFCPSPPVIPNGRHTGKPLEVFPPFGKTVNYTCDPHPDRGTS<br>FDLIGESTIRCTSDPQGNGVWSSPAPRCGILGHCQAPDHELFAKLKTQTNA<br>SDFPIGTSLKYECRPEYYGRPFSITCLDNLVWSSPKDVCKRKSCKTPPDPV<br>NGMVHVITDIQVGSRINYSCTTGHRLIGHSSAECILSGNAAHWSTKPPICQ<br>RIPCGLPPTIANGDFISTNRENFHYGSVVTYRCNPGSSGRKVFELVGEPSI<br>YCTSNDDQVGIWSGPAPQCIIPNKCTPPNVENGILVSDNRSLFSLNEVVEF<br>RCQPGFVMKGPRRVKCQALNKWEPELPSCSRVCQPPPDVLHAERTQRDKDN<br>FSPGQEVFYSCEPGYDLRGAASMRCTPQGDWSPAAPTCEVKSCDDFMGQLL<br>NGRVIFPVNLQLGAKVDEVCDEGFQLKGSSASYCVLAGMESLWNSSVPVCE<br>QIFCPSPPVIPNGRHTGKPLEVFPPFGKAVNYTCDPHPDRGTSFDLIGESTI<br>RCTSDPQGNGVWSSPAPRCGILGHCQAPDHELFAKLKTQTNASDFPIGTSL<br>KYECRPEYYGRPFSITCLDNLVWSSPKDVCKRKSCKTPPDPVNGMVHVITD<br>IQVGSRINYSCTTGHRLIGHSSAECILSGNTAHWSTKPPICQRIPCGLPPT<br>IANGDFISTNRENFHYGSVVTYRCNLGSRGRKVFELVGEPSIYCTSNDDQV<br>GIWSGPAPQCIIPNKCTPPNVENGILVSDNRSLFSLNEVVEFRCQPGFVMK<br>GPRRVKCQALNKWEPELPSCSRVCQPPPEILHGEHTPSHQDNFSPGQEVFY<br>SCEPGYDLRGAASIECTPQGDWSPEAPRCAVKSCDDFLGQLPHGRVIFPLN<br>LQLGAKVSFVCDEGFRLKGSSVSHCVINGMRSLWNNSVPVCEHIFCPNPPA<br>ILNGRHTGTPSGDIPYGKEISYTCDPHPDRGMTENLIGESTIRCTSDPHGN<br>GVWSSPAPRCELSVRAGHCKTPEQFPFASPTIPINDFEFPVGTSLNYECRP<br>GYFGKMESISCLENLVWSSVEDNCRRKSCGPPPEPENGMVHINTDTQFGST<br>VNYSCNEGFRLIGSPSTTCLVSGNNVTWDKKAPICEIISCEPPPTISNGDF<br>YSNNRTSFHNGTVVTYQCHTGPDGEQLFEINGERSIYCTSKDDQVGVWSSP<br>PPRCISTNKCTAPEVENAIRVPGNRSFFSLTEIIRFRCQPGFVMVGSHTVQ<br>CQTNGRWGPKIPHCSRVCQPPPEILHGEHTLSHQDNFSPGQEVFYSCEPSY<br>DLRGAASLHCTPQGDWSPEAPRCTVKSCDDFLGQLPHGRVLLPLNLQLGAK<br>VSFVCDEGFRLKGRSASHCVLAGMKALWNSSVPVCEQIFCPNPPAILNGRH<br>TGTPFGDIPYGKEISYACDTHPDRGMTENLIGESSIRCTSDPQGNGVWSSP<br>APRCELSVPAACPHPPKIQNGHYIGGHVSLYLPGMTISYICDPGYLLVGKG<br>FIECTDQGIWSQLDHYCKEVNCSFPLEMNGISKELEMKKVYHGDYVTLKC<br>EDGYTLEGSPWSQCQADDRWDPPLAKCTSRTHDALIVGTLSGTIFFILLII<br>FLSWIILKHRKGNNAHENPKEVAIHLHSQGGSSVHPRTLQTNEENSRVLP |

TABLE 36-continued

SEQUENCE TABLE

| SEQ ID NO: | DESCRIPTION | SEQUENCE |
|---|---|---|
| 9 | Factor H | >sp\|P08603\|CFAH_HUMA1 Complement factor H OS = Homo sapiens OX = 9606 GN = CFH PE = 1 SV = 4<br>MRLLAKIICLMLWAICVAEDCNELPPRRNTEILTGSWSDQTYPEGTQAIYK<br>CRFGYRSLGNVIMVCRKGEWVALNPLRKCQKRPCGHPGDTPFGTFTLTGGN<br>VFEYGVKAVYTCNEGYQLLGEINYRECDTDGWTNDIPICEVVKCLPVTAPE<br>NGKIVSSAMEPOREYHFGQAVRFVCNSGYKIEGDEEMHCSDDGFWSKEKPK<br>CVEISCKSPDVINGSPISQKIIYKENERFQYKGNMGYEYSERGDAVCTESG<br>WRPLPSCEEKSCDNPYIPNGDYSPLRIKHRTGDEITYQCRNGFYPATRGNT<br>AKCTSTGWIPAPRCTLKPCDYPDIKHGGLYHENMRRPYFPVAVGKYYSYYC<br>DEHFETPSGSYWDHIHCTQDGWSPAVPCLRKCYFPYLENGYNQNYGRKFVQ<br>GKSIDVACHPGYALPKAQTTVTCMENGWSPTPRCIRVKTCSKSSIDIENGF<br>ISESQYTYALKEKAKYQCKLGYVTADGETSGSITCGKDGWSAQPTCIKSCD<br>IPVFMNARTKNDFTWFKLNDTLDYECHDGYESNTGSTTGSIVCGYNGWSDL<br>PICYERECELPKIDVHLVPDRKKDQYKVGEVLKFSCKPGFTIVGPNSVQCY<br>HFGLSPDLPICKEQVQSCGPPPELLNGNVKEKTKEEYGHSEVVEYYCNPRF<br>LMKGPNKIQCVDGEWTTLPVCIVEESTCGDIPELEHGWAQLSSPPYYYGDS<br>VEFNCSESFTMIGHRSITCIHGVWTQLPQCVAIDKLKKCKSSNLIILEEHL<br>KNKKEFDHNSNIRYRCRGKEGWIHTVCINGRWDPEVNCSMAQIQLCPPPPQ<br>IPNSKNMTTTLNYRDGEKVSVLCQENYLIQEGEEITCKDGRWQSIPLCVEK<br>IPCSQPPQIEKGTINSSRSSQESYAHGTKLSYTCEGGFRISEENETTCYMG<br>KWSSPPQCEGLPCKSPPEISKGVVAHMSDSYQYGEEVTYKCFEGFGIDGPA<br>IAKCLGEKWSKPPSCIKTDCLSLPSFENAIPMGEKKDVYKAGEQVTYTCAT<br>YYKMDGASNVTCINSRWTGRPTCRDTSCVNPPTVQNAYIVSRQMSKYPSGE<br>RVRYQCRSPYEMFGDEEVMCLNGNWTEPPQCKDSTGKCGPPPPIDNGDITS<br>FPLSVYAPASSVEYQCNLYQLEGNKRITCRNGQWSEPPKCLHPCVISREI<br>MENYNIALRWTAKQKLYSRTGESVEFVCKRGYRLSSRSHTLRTTCWDGKLE<br>YPTCAKR |
| 10 | Factor H_mouse | >sp\|P06909\|CFAH_MOUSE Complement factor H OS = Mus musculus OX = 10090 GN = Cfh PE = 1 SV = 2<br>MRLSARITWLILWTVCAAEDCKGPPPPRENSEILSGSWSEQLYPEGTQATYK<br>CRPGYRTLGTIVKVCKNGKWVASNPSRICRKKPCGHPGDTPFGSFRLAVGS<br>QFEFGAKVVYTCDDGYQLLGEIDYRECGADGWINDIPLCEVVKCLPVTELE<br>NGRIVSGAAETDQEYYFGQVVRFECNSGFKIEGHKEIHCSENGLWSNEKPR<br>CVEILCTPPRVENGDGINVKPVYKENERYHYKCKHGYVPKERGDAVCTGSG<br>WSSQPFCEEKRCSPPYILNGIYTPHRIIHRSDDEIRYECNYGFYPVTGSTV<br>SKCTPTGWIPVPRCTLKPCEFRQFKYGRLYYEESLRPNFPVSIGNKYSYKC<br>DNGESPPSGYSWDYLRCTAQGWEPEVPCVRKCVEHYVENGDSAYWEKVYVQ<br>GQSLKVQCYNGYSLQNGQDTMTCTENGWSPPPKCIRIKTCSASDIHIDNGF<br>LSESSSIYALNRETSYRCKQGYVTNTGEISGSITCLQNGWSPQPSCIKSCD<br>MPVFENSITKNTRTWFKLNDKLDYECINGFENEYKHTKGSITCTYYGWSDT<br>PSCYERECSVPTLDRKLVVSPRKEKYRMGDLLEFSCHSGHRVGPDSVQCYH<br>FGWSPGFPTCKGQVASCAPPLEILNGEINGAKKVEYSHGEVVKYDCKPRFL<br>LKGPNKIQCVDGNWTTLPVCIEEERTCGDIPELEHGSAKCSVPPYHHGDSV<br>EFICEENFTMIGHGSVSCISGKWTQLPKCVATDQLEKCRVLKSTGIEAIKP<br>KLTEFTHNSTMDYKCRDKQEYERSICINGKWDPEPNCTSKTSCPPPPQIPN<br>TQVIETTVKYLDGEKLSVLCQDNYLTQDSEEMVCKDGRWQSLPRCIEKIPC<br>SQPPTIEHGSINLPRSSEERRDSIESSSHEHGTTFSYVCDDGFRIPEENRI<br>TCYMGKWSTPPRCVGLPCGPPPSIPLGTVSLELESYQHGEEVTYHCSTGFG<br>IDGPAFIICEGGKWSDPPKCIKTDCDVLPTVKNAIIRGKSKKSYRTGEQVT<br>FRCQSPYQMNGSDTVTCVNSRWIGQPVCKDNSCVDPPHVPNATIVTRTKNK<br>YLHGDRVRYECNKPLELFGQVEVMCENGIWTEKPKCRDSTGKCGPPPPIDN<br>GDITSLSLPVYEPLSSVEYQCQKYYLLKGKKTITCRNGKWSEPPTCLHACV<br>IPENIMESHNIILKWRHTEKTYSHSGEDIEFGCKYGYYKARDSPPFRTKCI<br>NGTINYPTCV |
| 11 | Exemplary B4 CDRH1 sequence | GYTFTDYY |
| 12 | Exemplary B4 CDRH2 sequence | INPNNGGT |
| 13 | Exemplary B4 CDRH3 sequence | ARYDYAWYFDV |
| 14 | Exemplary E4 CDRL1 sequence | QSIVHSNGNTY |
| 15 | Exemplary B4 CDRL2 sequence | KVS |

TABLE 36-continued

| SEQ ID NO: | DESCRIPTION | SEQUENCE |
|---|---|---|
| 16 | Exemplary B4 CDRL3 sequence | FQGSHVPYT |
| 17 | Exemplary C2 CDRH1 sequence | GYTFTSYW |
| 18 | Exemplary C2 CDRH2 sequence | INPSNGGT |
| 19 | Exemplary C2 CDRH3 sequence | ARRGIRLRHFDY |
| 20 | Exemplary C2 CDRL1 sequence | QDVGTA |
| 21 | Exemplary C2 CDRL2 sequence | WAS |
| 22 | Exemplary C2 CDRL3 sequence | QQYSSYPLT |
| 23 | Exemplary C3d (3d9a) CDRH1 sequence | GYTFTAYY |
| 24 | Exemplary C3d (3d9a) CDRH2 sequence | INPYNGGT |
| 25 | Exemplary C3d (3d9a) CDRH3 sequence | SSPY |
| 26 | Exemplary C3d (3d9a) CDRL1 sequence | QSLLDSDGKTY |
| 27 | Exemplary C3d (3d9a) CDRL2 sequence | LVS |
| 28 | Exemplary C3d (3d9a) CDRL3 sequence | WQGTHFPRT |
| 29 | Exemplary C3d (3d8b) CDRH1 sequence | GYTFTNYY |
| 30 | Exemplary C3d (3d8b) CDRH2 sequence | INPYNGGT |
| 31 | Exemplary C3d (3d8b) CDRH3 sequence | SSPY |

TABLE 36-continued

SEQUENCE TABLE

| SEQ ID NO: | DESCRIPTION | SEQUENCE |
|---|---|---|
| 32 | Exemplary C3d (3d8b) CDRL1 sequence | QSLLDSDGKTY |
| 33 | Exemplary C3d (3d8b) CDRL2 sequence | LVS |
| 34 | Exemplary C3d (3d8b) CDRL3 sequence | WQGTHFPRT |
| 35 | Exemplary C3d (3d29) CDRH1 sequence | GYTFTDYY |
| 36 | Exemplary C3d (3d29) CDRH2 sequence | INPYNGGT |
| 37 | Exemplary C3d (3d29) CDRH3 sequence | SRGGPY |
| 38 | Exemplary C3d (3d29) CDRL1 sequence | QSLLDSDGKTY |
| 39 | Exemplary C3d (3d29) CDRL2 sequence | LVS |
| 40 | Exemplary C3d (3d29) CDRL3 sequence | WQGTHFPRT |
| 41 | CR1 (1-10) | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSTYCTSKDDQVGIWSGPAPQCIIPNKCTPPNVEN GILVSDNRSLESLNEVVEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAEVDFVCDEGFQLKGSSAS YCVLAGMESLWNSSVPVCEQIFCPSPPVIPNGRHTGKPLEVFPFGKIVNYT CDPHYDRGTSFDLIGESTIRCTSDPQGNGVWSSPAPRCGILGHCQAPDEFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSWTYRCNPGSGGRK VFELVGEPSIYCTSNDDQVGIWSGPAPQCIIPNK |
| 42 | CR1 (1-17) | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVEYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPHPDRGTSFDLIGESTIRCTSDPQGNGVWSSPAPRCGILGHCQAPDHFL FAKLKTQTNASDFPIGTSLKYECRPEYYGRPFSITCLDNINWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKCTPPNVENGILVSDNRS LFSLNEVVEFRCQPGFVMKGPRRVKCQALNKWEPSLPSCSRVCQPPPDVLH AERTQRDKDNFSPGQEVFYSCEPGYDLRGAASMRCTPQGDWSPAAPTCEVK SCDDFMGQLLNGRVLFPVNLQLGAKVDFVCDEGFQLKGSSASYCVLAGMES LWNSSVPVCEQIPCPSPPVIPNGRHTGKPLEVEPFGKAVNYTCDPHPDRGT |

TABLE 36-continued

SEQUENCE TABLE

| SEQ ID NO: | DESCRIPTION | SEQUENCE |
|---|---|---|
|  |  | SFDLIGESTIRCTSDPQGNGVWSSPAPRCGILGHCQAPDHELFAKLKTQTN<br>ASDETIGTSLKYECRPEYYGRPFSITCLDNLVWSSPKDVCKRKSCKTPPDP<br>VNGMVHVITDIQVGSRINYSCTIGHRLIGHSSAECILSGNTAHWSTKPPIC<br>QRIPCGLPPTIANGDFISTNRENFHYGSVVTYRCNLGSRGRKVFELVGEPS<br>IYCTSNDDQVGIWSGPAPQCIIPNK |
| 43 | C2 scFv-<br>CR1 (1-10) | QVQLQQPGTELVKPGASVKLSCKASGYTFTSYWMHWVKQRPGQGLEWIGNI<br>NPSNGGTNYNEKEKSKAILTVDKSSSTAYMQLSSLTSEDSAVYYCARRGIR<br>LRHEDYWGQGTILTVSSGGGGSGGGGSGGGGSDIVNIQSHKEMSTSVGDRV<br>SITCKASQDVGTAVAWYQQKPGQSPKLLIYWASTRHTGVPDRFTGSGSGTD<br>FTLTISNVQSEDLADYFCQQYSSYPLTFGAGTKLELKGGGGSGGGGSQCNA<br>PEWLPFARPTNLTDEFEFPIGTYLNYECRPGYSGRPFSIICLKNSVWTGAK<br>DRCRRKSCRNPPDPVNGMVHVIKGIQFGSQIKYSCTKGYRLIGSSSATCII<br>SGDTVIWDNETPICDRIPCGLPPTITNGDFISTNRENITHYGSWTYRCNPG<br>SGGRKVFEINGEPSIYCISNDDQVGIWSGPAPQCIIPNKCTPPNVENGILV<br>SDNRSLFSLNEVVEFRCQPGFVMKGPRRVKCQALNKWEPELPSCSRVCQPP<br>PDVLHAERTQRDKDNFSPGQEVFYSCEPGYDLRGAASMRCTPQGDWSPAAP<br>TCEVKSCDDFMGQLLNGRVLFPVNLQLGAKVDFVCDEGFQLKGSSASYCVL<br>AGMESLWNSSVPVCEQIFCPSPPVIPNGRHTGKPLEVFPFGKTVNYTCDPH<br>PDRGTSFDLIGESTIRCTSDPQGNGVWSSPAPRCGILGHCQAPDHFLFAKL<br>KTQTNASDFPIGTSLKYECRPEYYGRPFSITCLDNLVWSSPKDVCKRKSCK<br>TPPDPVNGMVHVITDIQVGSRINYSCTTGHRLIGHSSAECILSGNAARWST<br>KPPICQRIPCGLPPTIANGDFISTNRENFHYGSVVTYRCNPGSGGRKVFEL<br>VGEPSIYCTSNDDQVGIWSGPAPQCIIPNK |
| 44 | C2 scFv-<br>Crry | QVQLQQPGTELVKPGASVKLSCKASGYTFTSYWMHWVKQRPGQGLEWIGNI<br>NPSNGGTNYNEKFKSKATLTVDKSSSTAYMQLSSLTSEDSAVYYCARRGIR<br>LRHFDYWGQGTTLTVSSGGGGSGGGGSGGGGSDIVMTQSHKFMSTSVGDRV<br>SITCKASQDVGTAVAWYQQKPGQSPKLLIYWASTRHTGVPDRFTGSGSGTD<br>FTLTISNINSEDLADYFCQQYSSYPLTFGAGTKLELKGGGGSGGGGSCPAP<br>SQLPSAKPINLTDESMFPIGTYLLYECLPGYIKRQFSIICKQDSTWTSAED<br>KCIRKQCKTPSDPENGLVHVHTGIQEGSRINYTCNQGYRLIGSSSAVCVII<br>DQSVDWDTEAPICEWIPCEIPPGIPNGDFFSSTREDFHYGMVVTYRCNTDA<br>RGKALFNLVGEPSLYCTSNDGEIGVWSGPPPQCIELNKCTPPPYVENAVML<br>SENRSLFSLRDIVEFRCHPGFIMKGASSVHCQSLNKWEPELPSCFKGVICR<br>LPQEMSGFQKGLGMKKEYYYGENVTLECEDGYTLEGSSQSQCQSDGSWNPL<br>LAKCVSRSI |
| 45 | C2-kappa<br>light<br>chain | DIVNIQSHKFMSTSVGDRVSITCKASQDVGTAVAWYQQKPGQSPKLLIYWA<br>STRHIGVPDRFIGSGSGTDFILTISNVQSEDLADYFCQQYSSYPLTFGAGT<br>KLELKPADAAPTVSIFPPSSEQLTSGGASVVCFLNNEYPKDINVKWKIDGS<br>ERQNGVLNSWTDQDSKDSTYSMSSTLTLTKDEYERHNSYTCEATHKTSTSP<br>IVKSFNRNEC |
| 46 | C2 IgG1<br>Fab Heavy<br>chain-<br>Crry | QVQLQQPGTELVKPGASVKLSCKASGYTFTSYWMHWVKQRPGQGLEWIGNI<br>NPSNGGINYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGGGGSGGGGSCPAPSQLPSAKPINLTDESMFPI<br>GTYLLYECLPGYIKRQFSIICKQDSTWTSAEDKCIRKQCKTPSDPENGLVH<br>VETGIQFGSRINYTCNQGYRLIGSSSAVCVIIDQSVDWDTEAPICEWIPCE<br>IPPGIPNGDFFSSTREDEFHYGMWTYRCNTDARGKALFNLVGEPSLYCTSN<br>DGEIGVWSGPPPQCIELNKCTPPPYVENAVMLSENRSLFSLRDIVEFRCHP<br>GFIMKGASSVHCQSLNKWEPELPSCFKGVICRLPQEMSGFQKGLGMKKEYY<br>YGENVTLECEDGYTLEGSSQSQCQSDGSWNPLLAKCVSRSI |
| 47 | C2 Fab<br>heavy<br>chain-CR1<br>(1-10) | QVQLQQPGTELVKPGASVKLSCKASGYTFTSYWKHWVKQRPGQGLEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGGGGSGGGGSQCNAPEWLPFARPTNLTDEFEFP<br>IGTYLNYECRPGYSGRPFSIICLKNSVWTGAKDRCRRKSCRNPPDPVNGKV<br>HVIKGIQFGSQIKYSCTKGYRLIGSSSATCIISGDTVIWDNETPICDRIPC<br>GLPPTITNGDFISTNRENFHYGSVVTYRCNPGSGGRKVFELVGEPSIYCTS<br>NDDQVGIWSGPAPQCIIPNKCTPPNVENGILVSDNRSLFSLNEVVEFRCQP<br>GFVMKGPRRVKCQALNKWEPELPSCSRVCQPPPDVLHAERTQRDKDNFSPG<br>QEVFYSCEPGYDLRGAASMRCTPQGDWSPAAPTCEVKSCDDFMGQLLNGRV<br>LFPVNLQLGAKVDFVCDEGFQLKGSSASYCVLAGMESLWNSSVPVCEQIFC<br>PSPPVIPNGRHTGKPLEVFPFGKTVNYTCDPHPDRGTSFDLIGESTIRCTS<br>DPQGNGVWSSPAPRCGILGRCQAPDHFLFAKLKTQTNASDFPIGTSLKYEC<br>RPEYYGRPFSITCLDNLVWSSPKDVCKRKSCKTPPDPVNGMVHVITDIQVG<br>SRINYSCTTGHRLIGHSSAECILSGNAAKWSTKPPICQRIPCGLPPTIANG<br>DFISTNRENFHYGSVVTYRCNPGSGGRKVFELVGEPSIYCTSNDDQVGIWS<br>GPAPQCIIPNK |

TABLE 36-continued

SEQUENCE TABLE

| SEQ ID NO: | DESCRIPTION | SEQUENCE |
|---|---|---|
| 48 | C2 Fab heavy chain-DR1 (1-17) | QVQLQQPGTELVKPCASVKLSCKASGYTFTSYWKHWVKQRPGQGLEWIGNI NPSNGGTNYNEKFKSKATLTVDKSSSTAYMQLSSLTSEDSAVYYCARRGIR LRHFDYWGQGTTLTVSSAKTTPPSVYPLAPGSAAQTNSMVTLGCLVKGYFP EPVTVTWNSGSLSSGVHTFPAVLQSDLYTLSSSVTVPSSTWPSETVTCKVA HPASSTKVDKKIVPRDCGGGGSGGGGSQCNAPEWLPFARPTNLTDEFEFP IGTYLNYECRPGYSGRPFSIICLKNSVWTGAKDRCRRKSCRNPPDPVNGKV HVIKGIQFGSQIKYSCTKGYRLIGSSSATCIISGDTVIWDNETPICDRIPC GLPPTITNGDFISTNRENFHYGSVVTYRCNPGSGGRKVFELVGEPSIYCTS NDDQVGIWSGPAPQCIIPNKCTPPNVENGILVSDNRSLFSLNEVVEFRCQP GFVMKGPRRVKCQALNKWEPELPSCSRVCQPPPDVLKAERTQRDKDNFSPG QEVFYSCEPGYDLRGAASMRCTPQGDWSPAAPTCEVKSCDDFKGQLLNGRV LFPVNLQLGAKVDFVCDEGFQLKGSSASYCVLAGMESLWNSSVPVCEQIFC PSPPVIPNGRHTGKPLEVFPFGKTVNYTCDPHPDRGTSFDLIGESTIRCTS DPQGNGVWSSPAPRCGILGHCQAPDHFLFAKLKTQTNASDFPIGTSLKYEC RPEYYGRPFSITCLDNLVWSSPKDVCKRKSCKTPPDPVNGMVHVITDIQVG SRINYSCTTGHRLIGHSSAECILSGNAAHWSTKPPICQRIPCGLPPTIANG DFISTNRENFHYGSVVTYRCNPGSGGRKVFELVGEPSIYCTSNDDQVGIWS GPAPQCIIPNKCTPPNVENGILVSDNRSLFSLNEVVEFRCQPGFVMKGPRR VkCQALNKWEPELPSCSRVCQPPPDVLHAERTQRDKDNFSPGQEVFYSCEP GYDLRGAASMRCTPQGDWSPAAPTCEVKSCDDFMGQLLNGRVLFPVNLQLG AKVDFVCDEGFQLKGSSASYCVLAGMESLWNSSVPVCEQIFCPSPPVIPNG RHTGKPLEVFPFGKAVNYTCDPHPDRGTSFDLIGESTIRCTSDPQGNGVWS SPAPRCGILGHCQAPDHFLFAKLKTQTNASDFPIGTSLKYECRPEYYGRPF SITCLDNLVWSSPKDVCKRKSCKTPPDPVNGMVHVITDIQVGSRINYSCTT GHRLIGHSSAECILSGNTAHWSTKPPICQRIPCGLPPTIANGDFISTNREN FHYGSVVTYRCNLGSRGRKVFELVGEPSIYCTSNDDQVGIWSGPAPQCIIP NK |
| 49 | CR1 (1-10)-C2 Fab heavy chain | QCNAPEWLPFARPTNLTDEFEFPIGTYLNYECRPGYSGRPFSIICLKNSVW TGAKDRCRRKSCRNPPDPVNGMVHVTKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEvvEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPKPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSQVQLQQP GTELVKPGASVKLSCKASGYTBTSYWMHWVKQRPGQGLEWIGNINPSNGGT NYNEKFKSKATLTVDKSSSTAYMQLSSLTSEDSAVYYCARRGIRLRHFDYW GQGTTLTVSSAKTTPPSVYPLAPGSAAQTNSMVTLGCLVKGYFPEPVTVTW NSGSLSSGVHTFPAVLQSDLYTLSSSVTVPSSTWPSETVTCNVAKPASSTK VDKKIVPRDCG |
| 50 | CR1 (1-17)-C2 Fab heavy chain | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASKRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPRPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKCTPPNVENGILVSDNRS LFSLNEVVEFRCQPGFVMKGPRRVKCQALNKWEPELPSCSRVCQPPPDVLH AERTQRDKDNFSPGQEVFYSCEPGYDLRGAASMRCTPQGDWSPAAPTCEVK SCDDFMGQLLNGRVLFPVNLQLGAKVDFVCDEGFQLKGSSASYCVLAGMES LWNSSVPVCEQIFCPSPPVIPNGRHTGKPLEVFPFGKAVNYTCDPHPDRGT SFDLIGESTIRCTSDPQGNGVWSSPAPRCGILGHCQAPDHFLFAKLKTQTN ASDFPIGTSLKYECRPEYYGRPFSITCLDNLVWSSPKDVCKRKSCKTPPDP VNGMVHVITDIQVGSRINYSCTTGHRLIGHSSAECILSGNTAHWSTKPPIC QRIPCGLPPTIANGDFISTNRENFHYGSVVTYRCNLGSRGRKVFELVGEPS IYCTSNDDQVGIWSGPAPQCIIPNKGGGGSGGGGSQVQLQQPGTELVKPGA SVKLSCKASGYTFTSYWMHWVKQRPGQGLEWIGNINPSNGGTNYNEKFKSK ATLTVDKSSSTAYMQLSSLTSEDSAVYYCARRGIRLRKFDYWGQGTTLTVS SAKTTPPSVYPLAPGSAAQTNSMVTLGCLVKGYFPEPVTVTWNSGSLSSGV HTFPAVLQSDLYTLSSSVTVPSSTWPSETVTCNVAHPASSTKVDKKIVPRD CG |

TABLE 36-continued

SEQUENCE TABLE

| SEQ ID NO: | DESCRIPTION | SEQUENCE |
|---|---|---|
| 51 | C2-IgG1 heavy chain | QVQLQQPGTELVKPGASVKLSCKASGYTFTSYWKKWVKQRPGQGLEWIGNI NPSNGGTMYNEKFKSKATLTVDKSSSTAYMQLSSLTSEDSAVYYCARRGIR LRHFDYWGQGTTLTVSSAKTTPPSVYPLAPGSAAQTNSMVTLGCLVKGYFP EPVTVTWNSGSLSSGVHTFPAVLQSDLYTLSSSVTVPSSTWPSETVTCNVA HPASSTKVDKKIVPRDCGCKPCICTVPEVSSVFIFPPKPKDVLTITLTPKV TCVVVDISKDDPEVQFSWFVDDVEVHTAQTQPREEQFNSTFRSVSELPIMH QDWLNGKEFKCRVNSAAFPAPIEKTISKTKGRPKAPQVYTIPPPKEQMAKD KVSLTCMITDFFPEDITVEWQWNGQPAENYKNTQPIMDTDGSYFVYSKLNV QKSNWEAGNTFTCSVLHEGLHNHHTEKSLSHSPG |
| 52 | C2-IgG1-CR1 (1-10), HC C-term x 2 | QVQLQQPGTELVKPGASVKLSCKASGYTFTSYWKHWVKQRPGQGLEWIGNI NPSNGGTNYNEKFKSKATLTVDKSSSTAYMQLSSLTSEDSAVYYCARRGIR LRHFDYWGQGTTLTVSSAKTTPPSVYPLAPGSAAQTNSMVTLGCLVKGYFP EPVTVTWNSGSLSSGVHTFPAVLQSDLYTLSSSVTVPSSTWPSETVTCNVA HPASSTKVDKKIVPRDCGCKPCICTVPEVSSVFIFPPKPKDVLTITLTPKV TCVVVDISKDDPEVQFSWFVDDVEVHTAQTQPREEQFNSTFRSVSELPIMH QDWLNGKEFKCRVNSAAFPAPIEKTISKTKGRPKAPQVYTIPPPKEQMAKD KVSLTCMITDFFPEDITVEWQWNGQPAENYKNTQPIMDTDGSYFVYSKLNV QKSNWEAGNTFTCSVLHEGLENHHTEKSLSHSPGGGGGSGGGGSQCNAPEW LPFARPTNLTDEFEFPIGTYLNYECRPGYSGRPFSIICLKNSVWTGAKDRC RRKSCRNPPDPVNGMVHVIKGIQFGSQIKYSCTKGYRLIGSSSATCIISGD TVIWDNETPICDRIPCGLPPTITNGDFISTNRENFHYGSVVTYRCNPGSGG RKVFELVGEPSIYCTSNDDQVGIWSGPAPQCIIPNKCTPPNVENGILVSDN RSLFSLNEVVEFRCQPGFVMKGPRRVKCQALNKWEPELPSCSRVCQPPPDV LHAERTQRDKDNFSPGQEVFYSCEPGYDLRGAASMRCTPQGDWSPAAPTCE VKSCDDFKGQLLNGRVLFPVNLQLGAKVDFVCDEGFQLKGSSASYCVLAGM ESLWNSSVPVCEQIFCPSPPVIPNGRHTGKPLEVFPFGKTVNYTCDPHPDR GTSFDLIGESTIRCTSDPQGNGVWSSPAPRCGILGHCQAPDHFLFAKLKTQ TNASDFPIGTSLKYECRPEYYGRPFSITCLDNLVWSSPKDVCKRKSCKTPP DPVNGMVHVITDIQVGSRINYSCTTGHRLIGHSSAECILSGNAAHWSTKPP ICQRIPCGLPPTIANGDFISTNRENFHYGSVVTYRCNPGSGGRKVFRLVGE PSIYCTSNDDQVGIWSGPAPQCIIPNK |
| 53 | C2 IgG1 heavy chain hole)-CR1 1-10 | QVQLQQPGTELVKPGASVKLSCKASGYIFISYWMHWVKQRPGQGLEWIGNI NPSNGGINYNEKFKSKATLIVDKSSSTAYMQLSSLTSEDSAVYYCARRGIR LRHFDYWGQGITLTVSSAKTIPPSVYPLAPGSAAQINSMVILGCLVKGYFP EPVTVTWNSGSLSSGVHTFPAVIQSDIYTLSSSVTVPSSTWPSETVTCNVA HPASSTKVDKKIVPRDCGCKPCICTVPEVSSVFIFPPKPKDVLTITLTPKV TCVVVDISKDDPEVQFSWFVDDVEVHIAQIQPREEQFNSIFRSVSELPIMH QDWLNGKEFKCRVNSAAFPAPIEKTISKTKGRPKAPQVYTIPPPKEQMAKD KVSLSCAIIDFFPEDITVEWQWNGQPAENYKNTQPIMDTDGSYFVVSKINV QKSNWEAGNTFTCSVLHEGLHNHHTEKSISHSPGGGGGSGGGGSQCNAPEW LPFARPTNLTDEFEFPIGTYLNYECRPGYSGRPFSIICLKNSVWTGAKDRC RRKSCRNPPDPVNGMVHVIKGIQFGSQIKYSCTKGYRLIGSSSATCIISGD TVIWDNETPICDRIPCGLPPTITNGDFISINRENFHYGSVVTYRCNPGSGG RKVFELVGEPSITCTSNDDQVGIWSGPAPQCIIPNKCTPPNVENGILVSDN RSIFSINEVVEFRCQPGEVMKGPRRVKCQAINKWEPEIPSCSRVCQPPPDV LHAERTQRDKDNFSPGQEVEYSCEPGYDLRGAASMRCIPQGDWSPAAPTCE VKSCDDEMGQLINGRVIFPVNLQLGAKVDEVCDEGFQLKGSSASYCVIAGM ESLWNSSVPVCEQIFCPSPPVTPNGRHIGKPLEVFPFGKIVNYTCDPHPDR GTSFDLIGESTIRCTSDPQGNGVWSSPAPRCGILGECQAPDHFLFAKIKIQ INASDFPIGTSLKYECRPEYYGRPFSITCLDNLVWSSPKDVCKRKSCKTPP DPVNGMVHVIIDIQVGSRINYSCTIGHRLIGHSSAECILSGNAAHWSTKPP ICQRIPCGLPPTIANGDFISTNRENFHYGSVVTYRCNEGSGGRKVFELVGE PSIYCTSNDDQVGIWSGPAPQCIIPNK |
| 54 | C2 IgG1 heavy chain (knob) | QVQLQQPGTELVKPGASVKISCKASGYTFISYWMHWVKQRPGQGLEWIGNI NPSNGGINYNEKFKSKATLIVDKSSSTAYMQLSSLTSEDSAVYYCARRGIR LRHFDYWGQGTILTVSSAKTIPPSVYPLAPGSAAQTNSMVTLGCLVKGYFP EPVTVTWNSGSLSSGVHIFPAVIQSDLYTLSSSVTVPSSIWPSETVICNVA HPASSTKVDKKIVPRDCGCKPCICTVPEVSSVFIFPPKPKDVITIILTPKV TCVVVDISKDDPEVQFSWFVDDVEVHIAQIQFREEQFNSTFRSVSEIPIMH QDWINGKEFKCRVNSAAFPAPIEKTISKTKGRPKAPQVYIIPPPKEQMAKD KVSLWCMITDFFPEDIIVEWQWNGQPAENYKNIQPIMDTDGSYEVYSKLNV QKSNWEAGNIFTCSVIHEGLHNHHTEKSLSHSPG |
| 55 | CR1 1-10-IgG1 Fc (hole) | QCNAPEWLEFARPINITDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGIPPIITNGDFISTNRENFHYGSVVTYR CNPGSGGRKVFELVGEPSIYCISNDDQVGIWSGEAPQCIIPNKCIPPNVEN GILVSDNRSLFSLNEVVEFRCQPGAINKWEPEIPSCSRV CQPPPDVLHAERTQRDKDNFSPGQEVEYSCEPGYDLRGAASMRCIPQGDWS PAAPTCEVKSCDDFMGQIINGRVIFPVNIQLGAKVDFVCDEGFQLKGSSAS YCVLAGMESLWNSSVPVCEQIFCPSPPVIPNGRHTGKPLEVFPFGKTVNYI CDPHPDRGTSFDLIGESTIRCTSDPQGNGVWSSPAPRCGIIGHCQAPDHFL FAKIKTQINASDFPIGTSLKYECRPEYYGRPFSIICLDNLVWSSPKDVCKR |

TABLE 36-continued

SEQUENCE TABLE

| SEQ ID NO: | DESCRIPTION | SEQUENCE |
|---|---|---|
| | | KSCKTPPDPVNGMVHVIIDIQVGSRINYSCTIGHRLIGHSSAECIISGNAA HWSTKPPICQRIPCGLPPTIANGDFISNRENFHYGSVVIYRCNPGSGGRK VFELVGEPSIYCISNDDQVGTWSGPAPQCIIPNKGGGGSGGGGSGCKPCIC TVPEVSSVFIPPPKPKDVLTITLTPKVTCVVVDISKDDPEVQFSWFVDDVE VHTAQTQPREEQFNSIFRSVSELPIMHQDWINGKEFKCRVNSAAFPAPIEK TISKIKGRPKAPQVYIIPPPKEQMAKDKVSLSCAIIDFFPEDITVEWQWNG QPAENYKNTQPIMDIDGSYFVVSKLNVQKSNWEAGNTFTCSVLHEGLHNHH TEKSISHSPG |
| 56 | CR1 1-10-C2 IgG1 heavy chain (hole) | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASKRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPHPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGPFISTNRENFHYGSVVTYRCNPGSGGRK VFELVGEPSIYCSNDDQVGIWSGPAPQCIIPNKGGGGSGGGGSQVQLQQP GTELVKPGASVKLSCKASGYTFTSYWMHWVKQRPGQGLEWIGNINPSNGGT NYNEKFKSKAILIVDKSSSTAYMQLSSLTSEDSAVYYCARRGIRLRHFDYW GQGTILIVSSAKTIPPSVYPLAPGSAAQINSMVILGCLVKGYTPEPVTVTW NSGSLSSGVHIFPAVLQSDLYILSSSVTVPSSTWPSETVICNVAHPASSTK VDKKIVPRDCGCKPCICTVPEVSSVFIPPPKPKDVLIITLTPKVTCVVVDI SKDDPEVQFSWFVDDVEVHTAQTQPREEQFNSTFRSVSELPIMHQDWLNGK EFKCRVNSAAFPAPIEKTISKIKGRPKAPQVYTIPPPKEQMAKDKVSLSCA ITDFFPEDITVEWQWNGQPAENYKNIQPIMDIDGSYFVVSKLNVQKSNWEA GNIFTCSVLHEGLHNHHTEKSLSHSPG |
| 57 | CR1 1-10-C2 kappa light chain | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPKPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSDIVMTQS HKFMSTSVGDRVSITCKASQDVGTAVAWYQQKPGQSPKLLIYWASTRHTGV PDRFTGSGSGTDFTLTISNVQSEDLADYFCQQYSSYPLTFGAGTKLELKRA DAAPTVSIFPPSSEQLTSGGASVVCFLNNFYPKDINVKWKIDGSERQNGVL NSWTDQDSKDSTYSMSSTLTLTKDEYERHNSYTCEATHKTSTSPIVKSFNR NEC |
| 58 | 3d29 IgG1 Fab heavy chain | EVQLQQSGPVLVKPGASVKMSCKASGYTFTDYYMNWVKQSHGKSLEWIGVI NPYNGGTSYNQKFKGKATLTVDKSSRTAYMELNSLISEDSAVYYCSRGGPY WGQGTILIVSSAKTTPPSVYPLAPGSAAQTNSMVTLGCLVKGYFPEPVTVT WNSGSLSSGVHTFRAVLQSDLYTLSSSVTVPSSTWPSETVTCNVAHPASST KVDKKIVPRDCG |
| 59 | 3d29 kappa light chain | DVVMTQTPLTLSVTIGQPASISCKSSQSLLDSDGKTYLNWLLQRPGQSPKR LIYLVSKLESGVPDRFTGSGSGTDFILEISRVEAEDLGVYYCWQGTHFPRI FGGGTKLEIKRADAAPTVSIFPPSSEQLTSGGASVVCFLNNFYPKDINVKW KIDGSERQNGVLNSWIDQDSKDSTYSMSSTLTLTKDEYERHNSYTCEATHK TSTSPIVKSFNRNEC |
| 60 | 3d29 IgG1 Fab heavy chain-Crry | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGGGGGSGGGGSCPAPSGLPSAKPINLTDESMFPIGTYLLY ECLPGYIKRQFSITCKQDSTWTSAEDKCIRKQCKTPSDPENGLVHVRTGIQ FGSRINYTCNQGYRLIGSSSAVCVITDQSVDWDTEAPICEWIPCEIPPGIP NGDFFSSTREDFHYGMVVTYRCNTDARGKALFNLVGEPSLYCTSNDGEIGV WSGPPPQCIELNKCTPPPYVENAVMLSENRSLFSLRDIVEFRCHPGFIMKG ASSVHCQSLNKWEPELPSCFKGVICRLPQEKSGFQKGLGMKKEYYYGENVT LECEDGYTLEGSSQSQCQSDGSWNPLLAKCVSRSI |

TABLE 36-continued

SEQUENCE TABLE

| SEQ ID NO: | DESCRIPTION | SEQUENCE |
| --- | --- | --- |
| 61 | 3d29 IgG1 Fab heavy chain-CR1 1-10 | EVQLQQSGPVLVKPGASVKMSCKASGYTSTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAKPASST KVDKKIVPRDCGGGGSGGGGSQCNAPEWLPFARPTNLTDEFEFPIGTYLN YECRPGYSGRPFSIICLKNSVWTGAKDRCRRKSCRNPPDPVNGMVRVTKGI QFGSQIKYSCTKGYRLIGSSSATCIISGDTVIWDNETPICDRIPCGLPPTI TNGDFISTNRENFHYGSVVTYRCKPCSGGRKVFELVCEPSIYCTSNDDQVC IWSGPAPQCIIPNKCTPPNVENGILVSDNRSLFSLNEVVEFRCQPGFVMKG PRRVKCQALNKWEPELPSCSRVCQPPPDVLHAERTQRDKDNFSPGQEVFYS CEPGYDLRGAASMRCTPQGDWSPAAPTCEVKSCDDFMGQLLNGRVLFPVML QLGAKVDFVCDEGFQLKGSSASYCVLAGMESLWNSSVPVCEQIFCPSPPVI PNGRHTGKPLEVFPPFGKTVNYTCDPHPDRGTSFDLIGESTIRCTSDPQGNG VWSSPAPRCGILGHCQAPDHFLFAKLKTQTNASDEPIGTSLKYECRPETYG RPFSITCLDNLVWSSPKDVCKRKSCKTPPDPVNGMVHVITDIQVGSRINYS CTTGHRLIGHSSAECILSGNAAHWSTKPPICQRIPCGLPPTIANGDFISTN RENFHYGSVVTYRCNPGSGGRKVFELVGEPSIYCTSNDDQVGIWSGPAPQC IIPNK |
| 62 | 3d29 IgG1 heavy chain murine IgG1 | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMHQDWLNG KEFKCRVNSAAFPAPIEKTISKTKGRPKAPQVYTIPPPKEQMAKDKVSLTC MITDFFPEDITVEWQWNGQPAENYKNTQPIMDTDGSYFVYSELNVQKSNWE AGNTFTCSVLHEGLHNHETEKSLSHSPG |
| 63 | 3d29 heavy chain murine IgG1-CR1 1-10 | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMHQDWLNG KEFKCRVNSAAFPAPIEKTISKTKGRPKAPQVYTIPPPKEQMAKDKVSLTC MITDFFPEDITVEWQWNGQPAENYKNTQPIMDTDGSYFVYSKLNVQKSNWE AGNTFTCSVLHEGLHNHHTEKSLSHSPGGGGGSGGGGSQCNAPEWLPFARP TNITDEFEFPIGTYLNYECRPGYSGRPFSIICLKNSVWTGAKDRCRRKSCR NPPDPVNGMVHVIKGIQFGSQIKYSCTKGYRLIGSSSATCIISGDTVIWDN ETPICDRIPCGLPPTITNGDFISTNRENFHYGSVVTYRCNPGSGGRKVFEL VGEPSIYCTSNDDQVGIWSGPAPQCIIPNKCTPPNVENGILVSDNRSLFSL NEVVEFRCQPGFVMKGPRRVKCQALNKWEPELPSCSRVCQPPPDVLHAERT QRDKDNFSPGQEVETSCEPGYDLRGAASMRCTPQGDWSPAAPTCEVKSCDD FMGQLLNGRVLFPVNLQLGAKVDFVCDEGFQLKGSSASYCVLAGMESLWNS SVPVCEQIFCPSPPVIPNGRHTGKPLEVFPPFGKTVNYTCDPHPDRGTSFDL IGESTIRCTSDPQGNGVWSSPAPRCGILGHCQAPDHFLFAKLKTQTNASDF PIGTSLKYECRPEYYGRPFSITCLDNLVWSSPKDVCKRKSCKTPPDPVNGM VHVITDIQVGSRINYSCTTGHRLIGHSSAECILSGNAAHWSTKPPICQRIP CGLPPTIANGDFISTNRENFHYGSVVTYRCNPGSGGRKVFELVGEPSIYCT SNDDQVGIWSGPAPQCIIPNK |
| 64 | 3d29 heavy chain hole) murine IgG1 | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKIIPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMHQDWLNG KEFKCRVNSAAFPAPIEKTISKTKGRPKAPQVYTIPPPKEQMAKDKVSLSC AITDFFPEDITVEWQWNGQPAENYKNTQPIMDTDGSYFVYSKLNVQKSNWE AGNTFTCSVLHEGLHNHHTEKSLSHSPG |
| 65 | 3d29 heavy chain (knob) murine IgG1-CR1 1-10 | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTIPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMHQDWLNG KEFKCRVNSAAFPAPIEKTISKTKGRPKAPQVYTIPPPKEQMAKDKVSLWC MITDFFPEDITVEWQWNGQPAENYKNTQPIMDTDGSYFVYSKLNVQKSNWE AGNTFTCSVLHEGIENHHTEKSLSHSPGGGGGSGGGGSQCNAPEWLPFARP TNLTDEFEFPIGTYLNYECRPGYSGRPFSIICLKNSVWTGAKDRCRRKSCR NPPDPVNGMVHVIKGIQFGSQIKYSCTKGYRLIGSSSATCIISGDTVIWDN ETPICDRIPCGLPPTITNGDFISTNRENFHYGSVVTYRCNPGSGGRKVFEL VGEPSIYCTSNDDQVGIWSGPAPQCIIPNKCTPPNVENGILVSDNRSLFSL NEVVEFRCQPGFVMKGPRRVKCQALNKWEPELPSCSRVCQPPPDVLHAERT |

TABLE 36-continued

SEQUENCE TABLE

| SEQ ID NO: | DESCRIPTION | SEQUENCE |
|---|---|---|
| | | QRDKDNFSPGQEVFYSCEPGYDLRGAASMRCTPQGDWSPAAPTCEVKSCDD FMGQLLNGRVLFPVNIQLGAKVDFVCDEGFQLKGSSASYCVLAGMESLWNS SVPVCEQIFCPSPPVIPNGRHIGKPLEVFPFGKTVNYICDPHPDRGTSFDL IGESTIRCTSDPQGNGVWSSPAPRCGILGHCQAPDHFLFAKLKTQTNASDF PIGTSLKYECRPEYYGRPFSITCLDNLVWSSPRDVCKRKSCKTPPDPVNGM VHVIIDIQVGSRINYSCTIGHRLIGHSSAECILSGNAAHWSTKPPICQRIP CGLPPTIANGDFISINRENFHYGSVVIYRCNPGSGGRKVFELVGEPSIYCT SNDDQVGIWSGPAPQCIIPNK |
| 66 | 3d29 IgG1 heavy chain-CR1 1-10 | EVQLQQSGPVLVKPGASVKMSCKASGYTFTDYYMNWVKQSHGKSLEWIGVI NPYNGGISYNQKFKGKATLIVDKSSRTAYMELNSLTSEDSAVYYCSRGGPY WGQGTILIVSSAKIIPPSVYPLAPGSAAQTNSMVTLGCLVKGYFPEPVIVI WNSGSLSSGVHTFPAVLQSDLYTLSSSVTVPSSTWPSETVICNVAPSSI KVDKKIVPRDCGCKPCICTVPEVSSVFIFPPKPKDVLTIILTPKVTCVVVD ISKDDPEVQFSWFVDDVEVHIAQTQPREEQFNSIFRSVSELPIMHQDWLNG KEFKCRVNSAAFPAPIEKTISKTKGRPKAPQVYIIPPPKEQMAKDKVSLTC MIIDFFPEDITVEWQWNGQPAENYKNTQPIMDTDGSYFVYSKLNVQKSNWE AGNTFTCSVLHEGLHNHHTEKSLSHSPGGGGSGGGGSQCNAPEWLPFARP INLIDEFEFPIGTYLNYECRPGYSGRPFSIICLKNSVWTGAKDRCRRKSCR NPPDPVNGMVHVIKGIQFGSQIKYSCTKGYRLIGSSSATCIISGDTVIWDN ETPICDRIPCGLPPIIINGDFISTNRENFHYGSVVTYRCNPGSGGRKVFEL VGEPSIYCTSNDDQVGIWSGPAPQCIIPNKCTPPNVENGILVSDNRSLFSL NEVVEFRCQPGFVMKGPRRVKCQALNKWEPELPSCSRVCQPPPDVLHAERT QRDKDNFSPGQEVFYSCEPGYDLRGAASMRCTPQGDWSPAAPTCEVKSCDD FMGQLLNGRVLFPVNLQLGAKVDFVCDEGFQLKGSSASYCVLAGMESLWNS SVPVCEQIFCPSPPVIPNGRHTGKPLEVFPFGKTVNYICDPHPDRGTSFDL IGESTIRCTSDPQGNGVWSSPAPRCGILGHCQAPDHFLFAKLKTQTNASDF PIGTSLKYECRPEYYGRPFSITCLDNLVWSSPKDVCKRKSCKTPPDPVNGM VHVIIDIQVGSRINYSCTIGHRLIGHSSAECILSGNAAHWSTKPPICQRIP CGIPPTIANGDFISTNRENFHYGSVVTYRCNPGSGGRKVFELVGEPSIYCT SNDDQVGIWSGPAPQCIIPNK |
| 67 | 3d8b Fab heavy chain murine IgG1 | EVQLQQSGPVINKPGASVKMSCKASGYTFTNYYINWVKQSHGESLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTISSSVTVPSSIWPSETVTCNVAHPASSTKV DKKIVPRDCG |
| 68 | 3d8b kappa light chain | DVVMTQTPLTLSVTIGQPASISCKSSQSLLDSDGKTYLNWLLQRPGQSPKR LIYLVSKLDSGVPDRFTGSGSGTDFTLKISRVEAEDLGVYYCWQGTHFPRI FGGGTKLEIRRADAAPTVSIFPPSSEQLTSGGASVVCFLNNFYPKDINVKW KIDGSERQNGVLNSWTDQDSKDSTYSMSSTLTLTKDEYERHNSYTCEATHK TSTSPIVKSFNRNEC |
| 69 | 3d8b Fab heavy chain murine IgG1-Crry | EVQLQQSGPVLVKPGASVKMSCKASGYTFTNYYINWVKQSHGKSLEWIGVI NPYNGGISYNQKFKGKATLIVDKSSSTAYMELNSLISEDSAVYFCSSPIED QGTSVTVSSAKTTPPSVYPLAPGSAAQTNSMVTLGCLVKGYFPEPVTVTWN SGSLSSGVHTFPAVLQSDLYTLSSSVTVTSSTWPSETVTCNVAHPASSTKV DKKIVPRDCGGGGSGGGGSCPAPSQLPSAKPINLTDESMFPIGTYLLYEC LPGYIKRQFSITCKQDSTWTSAEDKCIRKQCKTPSDPENGLVHVHTGIQFG SRINYTCNQGYRLIGSSSAVCVITDQSVDWDTEAPICEWIPCEIPPGIPNG DFFSSIREDFHYGMVVIYRCNIDARGKALFYLVGEPSLYCISNDGEIGVWS GPPPQCIELNKCIPPPYVENAVMLSENRSLFSLRDIVEFRCHPGFIMKGAS SVHCQSLNKWEPELPSCFKGVICRLPQEMSGFQKGLGMKKEYYYGENVTLE CEDGYTLEGSSQSQCQSDGSWNPLLAKCVSRSI |
| 70 | 3d8b Fab heavy chain murine IgG1-CR1 1-10 | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGGGGSGGGGSQCNAPEWLPFARPTNLTDEFEFPIGTYLNYE CRPGYSGRPFSIICLKNSVWTGAKDRCRRKSCRNPPDPVNGMVHVIKGIQF GSQIKYSCTKGYRLIGSSSATCIISGDTVIWDNETPICDRIPCGLPPTITN GDFISTNRENFHYGSVVTYRCNPGSGGRKVFELVGEPSIYCTSNDDQVGIW SGPAPQCIIPNKCTPPNVENGILVSDNRSLFSLNEVVEFRCQPGFVMKGPR RVKCQALMKWEPELPSCSRVCQPPPDVLHAERTQRDKDNFSPGQEVFYSCE PGYDLRGAASMRCTPQGDWSPAAPTCEVKSCDDFMGQLLNGRVLFPVNLQL GAKVDFVCDEGFQLKGSSASYCVLAGMESLWNSSVPVCEQIFCPSPPVIPN GRHTGKPLEVFPFGKTVMYTCDPHPDRGTSFDLIGESTIRCTSDPQGNGVW SSPAPRCGILGHCQAPDHFLFAKLKTQTNASDFPIGTSLKYECRPEYYGRP FSITCLDNLVWSSPKDVCKRKSCKTPPDPVNGMVHVITDIQVGSRINYSCT TGHRLIGHSSAECILSGNAAHWSTKPPICQRIPCGLPPTIANGDFISTKRE NFHYGSVVTYRCNPGSGGRKVFELVGEPSIYCTSNDDQVGIWSGPAPQCII PNK |

TABLE 36-continued

SEQUENCE TABLE

| SEQ ID NO: | DESCRIPTION | SEQUENCE |
| --- | --- | --- |
| 71 | 3d8b Fab heavy chain murine IgG1-fH 1-5 | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKIIPPSVYPLAPGSAAQINSMVILGCLVKGYFPEPVTVTWN SGSLSSGVHTETAVLQSDLYTLSSSVTVPSSTWPSETVTCNVAHPASSTKV DKKIVPRDCGGGGSGGGGSGGGGSEDCNELPPRRNTEILTGSWSDQTYPEGT QAIYKCRPGYRSLGNVIMVCRKGEWVALNPLRKCQKRPCGHPGDTPFGTFTLTG GNVFEYGVKAVYTCNEGYQLLGEINYRECDTDGWTNDIPICEVVKCLPVTA PENGKIVSSAMEPDREYHFGQAVRFVCNSGYKIEGDEEMHCSDDGFWSKEK PKCVEISCKSPDVINGSPISQKIIYKENERFQYKCNMGYEYSERGDAVCTE SGWRPLPSCEEKSCDNPYIPNGDYSPLRIKHRTGDEITYQCRNGFYPATRG NTAKCTSTGWIPAPRCTLK |
| 72 | Control soluble factor H 1-5 | EDCNELPPRRNTEILIGSWSDQTYPEGTQALYKORPGYRSLGNVIMVCRKG EWVALNPLRKCQKRPCGHPGDTPFGTFTLIGGNVFEYGVKAVYTCNEGYQL LGEINYRECDTDGWTNDIPICEVVKCLPVTAPENGKIVSSTEEPDREYHFG QAVRFVCNSGYKIEGDEEMHCSDDGFWSKEKPKCVEISCKSPDVINGSPIS QKIIYKENERFQYKCNMGYEYSERGDAVCTESGWRPLPSCEEKSCDNPYIP NGDYSPLRIKHRTGDEITYQCRNGFYPATRGNTAKCTSTGWIPAPRCTLK |
| 73 | 3d8b heavy chain murine IgG1 | EVQLQQSGPVLVKPGASVKMSCKASGYTFTNYYINWVKQSHGKSLEWIGVI NPYNGGTSYNQKFKGKAILTVDKSSSTAYMELNSLTSEDSAVYFCSSPYWG QMTSVTVSSAKTTPPSVYPLAPGSAAQTNSYNTLGCLVKGYETEPVTVTWN SGSLSSGVHTFPAVLQSDLYTLSSSVTVPSSTWPSETVTCNVAHPASSTKV DKKIVPRDCGCKPCICTVPEVSSVFIFTPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCMI TDFFPEDITVEWQWNGQPAENYKNTQPIMDTDGSYFVYSKLNVQKSNWEAG NTFTCSVLHEGLENHHTEKSLSHSPG |
| 74 | 3d8b heavy chain murine IgG1 (knob) | EVQLQQSGPVINKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKITPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLWCMI TDFFPEDITVEWQWNGQPAENYKNTQPIMDTDGSYFVYSKLNVQVSNWEAG NTFTCSVLHEGLHNHHTEKSLSHSPG |
| 75 | 3d8b heavy chain murine IgG1 (hole)-CR1 1-10 +pairs with knob | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPP5VYPIAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLSCAI TDFFPEDITVEWQWNGQPAENYKNTQPIMDTDGSYFVVSKLNVQKSNWEAG NTFTCSVLHEGLHNHHTEKSLSHSPGGGGGSGGGGSQCNAPEWLPFARPTN LTDEFEFPIGTYLNYECRPGYSGRPFSIICLKNSVWTGAKDRCRRKSCRNP PDPVNGMVHVIKGIQFGSQIKYSCTKGYRLIGSSSATCIISGDTVIWDNET PICDRIPCGLPPTITNGDFISTNRENFHYGSVVTYRCNPGSGGRKVFELVG EPSIYCTSNDDQVGIWSGPAPQCIIPNKCTPPNVENGILVSDNRSLFSLNE VVEFRCQPGFVMKGPRRVKCQALNKWEPELPSCSRVCQPPPDVLHAERTQR DKDNFSPGQEVFYSCEPGYDLRGAASMRCTPQGDWSPAAPTCEVKSCDDFM GQLLNGRVLFPVNLQLGAKVDFVCDEGFQLKGSSASYCVLAGMESLWNSSV PVCEQIFCPSPPVIPNGRHTGKPLEVFPPFGKTVNYTCDPHPDRGTSFDLIG ESTIRCTSDPQGNGVWSSPAPRCGILGHCQAPDHFLFAKLKTQTNASDFPI GTSLKYECRPEYYGRPFSITCLDNLVWSSPKDVCKRKSCKTPPDPVNGMVH VITDIQVGSRINYSCTTGHRLIGHSSAECILSGNAAHWSTKPPICQRIPCG LPPTIANGDFISTNRENFHYGSVVTYRCNPGSGGRKVFELVGEPSIYCTSN DDQVGIWSGPAPQCIIPNK |
| 76 | 3d8b heavy chain murine IgG1-CR1 1-10 | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCMI TDFFPEDITVEWQWNGQPAENYKNTQPIMDTDGSYFVYSKLNVQKSNWEAG NTFTCSVLHEGLKNHHTEKSLSHSPGGGGGSGGGGSQCNAPEWLPFARPTN LTDEFEFPIGTYLNYECRPGYSGRPFSIICLKNSVWTGAKDRCRRKSCRNP PDPVNGMVHVIKGIQFGSQIKYSCTKGYRLIGSSSATCIISGOTVIWDNET PICDRIPCGLPPTITNGDFISTNRENFHYGSVVTYRCNPGSGGRKVFELVG EPSIYCTSNDDQVGIWSGPAPQCIIPNKCTPPNVENGILVSDMRSLFSLNE VVEFRCQPGFVMKGPRRVKCQALMCWEPELPSCSRVCQPPPDVLKAERTQR |

TABLE 36-continued

SEQUENCE TABLE

| SEQ ID NO: | DESCRIPTION | SEQUENCE |
|---|---|---|
| | | DKDNFSPGQEVFYSCEPGYDLRGAASMRCTPQGDWSPAAPTCEVKSCDDFM<br>GQLLNGRVLFPVNLQLGAKVDFVCDEGFQLKGSSASYCVLAGMESLWNSSV<br>PVCEQIFCPSPPVIPNGRHTGKPLEVFPFGKTVNYTCDPHPDRGTSFDLIG<br>ESTIRCTSDPQGNGVWSSPAPRCGILGHCQAPDHFLFAKLKTQTNASDFPI<br>GTSLKYECRPEYYGRPFSITCLDNLVWSSPKDVCKRKSCKTPPDPVNGMVH<br>VITDIQVGSRINYSCTTGHRLIGHSSAECILSGNAARWSTKPPICQRIPCG<br>LPPTIANGDFISTNRENFHYGSVVTYRCNPGSGGRKVFELVGEPSIYCTSN<br>DDQVGIWSGPAPQCIIPNK |
| 77 | 3d8b<br>kappa<br>light<br>chain-<br>CR1 1-10 | DVVMTQTPLTLSVTIGQPASISCKSSQSLLDSDGKTYLNWLLQRPGQSPKR<br>LIYLVSKLDSGVPDRETGSGSGTDFTLKISRVEAEDLGVYYCWQGTHEPRT<br>FGGGTKLEIRRADAAPTVSIFPPSSEQLTSGGASVVCFLNNEYPKDINVKW<br>KIDGSERQNGVLNSWTDQDSKDSTYSMSSTLTLTKDEYERHNSYTCEATHK<br>TSTSPIVKSFNRNECGGGGSGGGGSQCNAPEWLPFARPTNLTDEFEFPIGT<br>YLNYECRPGYSGRPFSIICLKNSVWTGAKDRCRRKSCRNPPDPVNGMVHVI<br>KGIQFGSQIKYSCTKGYRLIGSSSATCIISGDTVIWDNETPICDRIPCGLP<br>PTITNGDFISTNRENFHYGSVVTYRCNPGSGGRKVFELVGEPSIYCTSNDD<br>QVGIWSGPAPQCIIPNKCTPPNVENGILVSDNRSLFSLNEVVEFRCQPGFV<br>MEGPRRVKCQALNKWEPELPSCSRVCQPPPDVLHAERTQRDKDNFSPGQEV<br>FYSCEPGYDLRGAASMRCTPQGDWSPAAPTCEVKSCDDFMGQLLNGRVLFP<br>VNLQLGAKVDPVCDEGFQLKGSSASYCVLAGMESLWNSSVPVCEQIFCPSP<br>PVIPNGRHTGKPLEVFPEGKTVNYTCDPHPDRGTSFDLIGESTIRCTSDPQ<br>GNGVWSSPAPRCGILGHCQAPDHFLFAKLKTQTNASDFPIGTSLKYECRPE<br>YYGRPFSITCLDNLVWSSPKDVCKRKSCKTPPDPVNGMVHVITDIQVGSRI<br>NYSCTTGHRLIGHSSAECILSGNAAHWSTKPPICQRIPCGLPPTIANGDFI<br>STNRENFHYGSVVTYRCNPGSGGRKVFELVGEPSIYCTSNDDQVGIWSGPA<br>PQCIIPNK |
| 78 | CR1 1-10-<br>3d8b<br>heavy<br>chain<br>murine<br>IgG1 | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGIWSGPAPQCIIPNKCTPPNVEN<br>GILVSDNRSLFSLNEVVEFRCQPGFWIKGPRRVKCQALNKWEPELPSCSRV<br>CQPPPDVLHAERTQRDKDNFSPGQEVFYSCEPGYDLRGAASMRCTPQGDWS<br>PAAPTCEVKSCDDFMGQLLNGRVLFPVNLQLGAKVDFVCDEGFQLKGSSAS<br>YCVLAGMESLWNSSVPVCEQIFCPSPPVIPNGRHTGKPLEVEPECKTVNYT<br>CDPHPDRGTSFDLIGESTIRCTSDPQGNGVWSSPAPRCGILGHCQAPDHEL<br>FAKLKTQTNASDFPIGTSLKYECRPEYYGRPFSITCLDNLVWSSPKDVCKR<br>KSCKTPPDPVNGMVHVITDIQVGSRINYSCTTGHRLIGHSSAECILSGNAA<br>HWSTKPPICQRIPCGLPPTIANGDFISTNRENFHYGSVVTYRCNPGSGGRK<br>VFELVGEPSIYCTSNDDQVGIWSGPAPQCIIPNKGGGGSGGGGSEVQLQQS<br>GPVLVKPGASVKMSCKASGYTFTNYYINWVKQSHGKSLEWIGVINPYNGGT<br>SYNQKFKGKATLTVDKSSSTAYMELNSLTSEDSAVYFCSSPYWGQGTSVTV<br>SSAKTIPPSVYPLAPGSAAQTNSMVTLGCLVKGYFPEPVTVTWNSGSLSSG<br>VHTFPAVLQSDLYTLSSSVTVPSSTWPSETVICNVAHPASSTKVDKKIVPR<br>DCGCKPCICTVPEVSSVFIFPPKPKDVLTITLTPKVTCVVVDISKDDPEVQ<br>FSWFVDDVEVHTAQTQPREEQFNSTFRSVSELPIMHQDWLNGKEFKCRVNS<br>AAFPAPIEKTISKTKGRPKAPQVYTIPPPKEQMAKDKVSLTCMITDFFPED<br>ITVEWQWNGQPAENYKNTQPIMDTDGSYFVYSKLNVQKSNWEAGNTFTCSV<br>LHEGLHNHHTEKSLSHSPG |
| 79 | CR1 1-10-<br>3d8b<br>kappa<br>light<br>chain | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGIWSGPAPQCIIPNKCTPPNVEN<br>GILVSDNRSLFSLNEVVEFRCQPGFVMKGPRRVKCQALNKWEPELPSCSRV<br>CQPPPDVLHAERTQRDKDNFSPGQEVFYSCEPGYDLRGAASMRCTPQGDWS<br>PAAPTCEVKSCDDFMGQLLNGRVLFPVNLQLGAKVDFVCDEGFQLKGSSAS<br>YCVLAGMESLWNSSVPVCEQIFQPSPPVIPNGRHTGEPLEVFPFGKTVNYT<br>CDPHPDRGTSFDLIGESTIRCTSDPQGNGVWSSPAPRCGILGHCQAPDHFL<br>FAKLKIQTNASDFPIGTSLKYECRPEYYGRPFSIICLDNLVWSSPKDVCKR<br>KSCKTPPDPVNGMVHVITDIQVGSRINYSCTTGHRLIGHSSAECILSGNAA<br>HWSTKPPICQRIPCGLPPTIANGDFISTNRENFHYGSVVIYRONPGSGGRK<br>VFELVGEPSIYCTSNDDQVGIWSGPAPQCIIPNKGGGGSGGGGSDVVMTQT<br>PLTLSVTIGQPASISCKSSQSLLDSDGKTYLNWLLQRPGQSPKRLIYLVSK<br>LDSGVPDRFTGSGSGTDFTLKISRVEAEDLGVYYCWQGTHFPRTFGGGTKL<br>EIRRADAAPTVSIFPPSSEQLTSGGASVVCFLNNFYPKDINVKWKIDGSER<br>QNGVLNSWTDQDSKDSTYSMSSTLTLTKDEYERHNSYTCEATHKTSTSPIV<br>KSFNRNEC |
| 80 | CR1 1-10-<br>murine<br>IgG1 Fc<br>(knob) | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGINSGRAPQCIIPNKCTPPNVEN<br>GILVSDNRSLFSLNEVVEFRCQPGFVMKGPRRVKCQALNKWEPELPSQSRV<br>CQPPPDVLHAERTQRDKDNFSPGQEVEYSCEPGYDLRGAASMRCTPQGDWS |

TABLE 36-continued

SEQUENCE TABLE

| SEQ ID NO: | DESCRIPTION | SEQUENCE |
|---|---|---|
| | | PAAPTCEVKSCDDFMGQLLNGRVLFPVNLQLGAKVBFVCDEGFQLKGSSAS YCVLAGMESLWNSSVPVCEQIFCPSPPVIPNGRHTGEPLEVFPFGKTVNYT CDPEPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSGCKPCIC TVPEVSSVFIFPPKPKDVLTITLTPKVTCVVVDISKDDPEVQFSWFVDDVE VHTAQTQPREEQFNSTFRSVSELPIMHQDWLNGKEFKCRVNSAAFPAPIEK TISKTKGRPKAPQVYTIPPPKEQMAKDKVSLWCMITDFFPEDITVEWQWNG QPAENYKNTQPIMDTDGSYFVYSKLNVQKSNWEAGNTFTCSVLHEGLHNHH TEKSLSHSPG |
| 81 | 3d8b heavy chain murine IgG1 (hole) | EVQLQQSGPVINKPGASVKMSCKASGYTFTNYYINWVKQSHGESLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVICNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLSCAI TDFFPEDITVEWQWNGQPAENYKNTQPIMDTDGSYFVVSKLNVQKSNWEAG NTFTCSVLHEGLHNHHTEKSLSHSPG |
| 82 | 3d8b heavy chain murine IgG1 (hole)- fH 1-5 | EVQLQQSGPVINKPGASVKMSCKASGYIFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVICNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLSCAI TDFFPEDITVEWQWNGQPAENYKNTQPIMDTDGSYFVVSKLNVQKSNWEAG NTFTCSVLHEGLHNHHTEKSISHSPGGGGGSGGGGSEDCNELPPRRNTEIL TGSWSDQTYPEGTQATYKCRPGYRSLGNVIMVCRKGEWVALNPLRKCQKRP CGHPGDTPFGTFTLTGGNVFEYGVKAVYTCNEGYQLLGEINYRECDTDGWT NDIPICEVVKCLPVTAPENGKIVSSAMEPDREYHFGQAVRFVCNSGYKIEG DEEMHCSDDGFWSKEKPKCVEISCKSPDVINGSPISQKIIYKENERFQYKC NMGYEYSERGDAVCTESGWRPLPSCEEKSCDNPYIPNGDYSPLRIKHRTGD EITYQCPNGFYPATRGNTAKCTSTGWIPAPRCTLK |
| 83 | 3d8b heavy chain murine IgG1-fH 1-5 | EVQLQQSGPVLVKPGASVKMSCKASGYTFTKYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVICNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCMI TDFFPEDITVEWQWNGQPAENYKNTQPIMDTDGSYFVYSKLNVQKSNWEAG NTFTCSVLHEGLHNHHTEKSLSHSPGGGGGSGGGGSEDCNELPPRRNTEIL TGSWSDQTYPEGTQAIYKCRPGYRSLGNVIMVCRKGEWVALNPLRKCQKRP CGHPGDTPFGTFTLTGGNVFEYGVKAVYTCNEGYQLLGEINYRECDTDGWT NDIPICEVVKCLPVTAPENGKIVSSAMEPDREYHFGQAVRFVCNSGYKIEG DEEMHCSDDGFWSKEKPKCVEISCKSPDVINGSPISQKIIYKENERFQYKC NMGYEYSERGDAVCTESGWRPLPSCEEKSCDNPYIPNGDYSPLRIKHRTGD EITYQCRNGFYPATRGNTAKCTSTGWIPAPRCTLK |
| 84 | 3d8b kappa light chain- fH 1-5 | DVVMTQTPLTLSVTIGQPASISCKSSQSLLDSDGKTYLNWLLQRPGQSPKR LIYLVSKLDSGVPDRFTGSGSGTDETLKISRVEAEDLGVYYCWQGTHFPRT FGGGTKLEIRRADAAPTVSIFPPSSEQLTSGGASVVCFLNNEYPKDINVKW KIDGSERQNGVLNSWTDQDSKDSTYSMSSTLTLTKDEYERHNSYTCEATHK TSTSPIVKSFNRNECGGGGSGGGGSEDCNELPPRRNTEILTGSWSDQTYPE GTQAIYKCRPGYRSLGNVIMVCRKGEWVALNPLRKCQKRPCGHPGDTPFGT FTLTGGNVFEYGVKAVYTCNEGYQLLGEINYRECDTDGWTNDIPICETVKC LPVTAPENGKIVSSAMEPDREYHFGQAVREVCNSGYKIEGDEEMHCSDDGF WSKEKPKCVEISCKSPDVTNGSPISQKIIYKENERFQYKCNMGYEYSERGD AVCTESGWRPLPSCEEKSCDNPYIPNGDYSPLRIKHRTGDEITYQCRNGFY PATRGNTAKCTSTGWIPAPRCTLK |
| 85 | fH 1-5- 3d8b heavy chain murine IgG1 | EDCNELPPRRNTEILTGSWSDQTYPEGTQAIYKORPGYRSLGNVIMVCRKG EWVALNPLRKCQKRPCGHPGDTPFGTFTLTGGNVFEYGVKAVYTCNEGYQL LGEINYRECDTDGWTNDIPICEVVKCLPVTAPENGKIVSSAMEPDREYHFG QAVRFVCNSGYKIEGDEEMHCSDDGFWSKEKPKCVEISCKSPDVINGSPIS QKIIYKENERFQYKCNMGYEYSERGDAVCTESGWRPLPSCEEKSCDNPYIP NGDYSPLRIKHRTGDEITYQCRNGEYPATRGNTAKCTSTGWIPAPRCTLKG GGGSGGGGSEVQLQQSGPVLVKPGASVKMSCKASGYTFTNYYINWVKQSHG KSLEWIGVINPYNGGTSYNQKFKGKATLTVDKSSSTAYMELNSLTSEDSAV YFCSSPYWGQGTSVTVSSAKTTPPSVYPLAPGSAAQTNSMVTLGCLVKGYF |

TABLE 36-continued

SEQUENCE TABLE

| SEQ ID NO: | DESCRIPTION | SEQUENCE |
|---|---|---|
| | | PEPVTVTWNSGSLSSGWITFPAVLQSDLYTLSSSVTVPSSTWPSETVTCNV<br>AHPASSTKVDKKIVPRDCGKPCICTVPEVSSVFIFPPKPKDVLTITLTPK<br>VTCVVVDISKDDPEVQFSWFVDDVEVHTAQTQPREEQFNSTFRSVSELPIM<br>HQDWLNGKEFKCRVNSAAFPAPIEKTISKTGRPKAPQVYTIPPPKEQMAK<br>DKVSLTCMITDFFPEDITVEWQWNGQPAENYKNTQPIMDTDGSYFVYSKLN<br>VQKSNWEAGNTFTCSVLHEGLHNHHTEKSLSHSPG |
| 86 | fH 1-5-<br>3d8b<br>kappa<br>light<br>chain | EDCNELPPRRNTEILTGSWSDQTYPEGTQAIYKCRPGYRSLGNVIMVCRKG<br>EWVALNPLRYCQKRPCGHPGDTPFGTFTLTGGNVFEYGVKAVYTCNEGYQL<br>LGEINYRECDTDGWTNDIPICEVVKCLPVTAPENGKIVSSAMEPDREYHFG<br>QAVRFVCNSGYKIEGDEEMHCSDDGFWSKEKPKCVEISCKSPDVINGSPIS<br>QKIIYKENERFQYKCNMGYEYSERGDAVCTESGWRPLPSCEEKSCDNPYIP<br>NGDYSPLRIKHRTGDEITYQCRNGFYPATRGNTAKCTSTGWIPAPRCTLKG<br>GGGSGGGGSDVVMTQTPLTLSVTIGQPASISCKSSQSLLDSDGKTYLNWLL<br>QRPGQSPKRLTYLVSKLDSGVPDRFTGSGSGTDFTLKISRVEAEDLGVYYC<br>WQGTHEPRTFGGGTKLEIRRADAAPTVSIFPPSSEQLTSGGASVVCFLNNF<br>YPKDINVKWKIDGSERQNGVLNSWTDQDSKDSTYSMSSTLTLTKDEYERHN<br>SYTCEATHKTSTSPIVKSFNRNEC |
| 87 | fH 1-5-<br>murine<br>IgG1 Fc<br>(knob) | EDCNELPPRRNTEILTGSWSDQTYPEGTQAIYKCRPGYRSLGNVIMVCRKG<br>EWVALNPLRKCQKRPCGHPGDTPFGTFTLTGGNVFEYGVKAVYTCNEGYQL<br>LGEINYRECDTDGWTNDIPICEVVKCLPVTAPENGKIVSSAMEPDREYHFG<br>QAVRFVCNSGYKIEGDEEMHCSDDGFWSKEKPKCVEISCKSPDVINGSPIS<br>QKIIYKENERFQYKCNMGYEYSERGDAVCTESGWRPLPSCEEKSCDNPYIP<br>NGDYSPLRIKHRTGDEITYQCRNGFYPATRGNTAKCTSTGWIPAPRCTLKG<br>GGGSGGGGSGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTGRPKAPQVYTIPPPKEQMAKDKVSLWCMI<br>TDFFPEDITVEWQWNGQPAENYKNTQPIMDTDGSYFVYSKLNVQKSNWEAG<br>NTFTCSVLHEGLHNHHTEKSLSHSPG |
| 88 | 3d8b<br>heavy<br>chain<br>murine<br>IgG1 Fc<br>(hole) | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLPSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTGRPKAPQVYTIPPPKEQMAKDKVSLSCAI<br>TDFFPEDITVEWQWNGQPAENYKNTQPIMDTDGSYFVVSKLNVQKSNWEAG<br>NTFTCSVLHEGLHNHHTEKSLSHSPG |
| 89 | 3d8b VH-<br>IgG1 with<br>T366S/M368A/<br>Y407V<br>hole Fc | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTGRPKAPQVYTIPPPKEQMAKDKVSLSCAI<br>TDFFPEDITVEWQWNGQPAENYKNTQPIMDTDGSYFVVSKLNVQKSNWEAG<br>NTFTCSVLHEGLHNHHTEKSLSHSPG |
| 90 | CR1 (1-10)-<br>linker-<br>IgG1 with<br>T366W<br>knob Fc | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGIWSGPAPQCIIPNKCTPPNVEN<br>GILVSDNRSLFSLNEVVEFRCQPGFVMKGPRRVKCQALNKWEPELPSCSRV<br>CQPPPDVLHAERTQRDKDNFSPGQEVFYSCEPGYDLRGAASMRCTPQGDWS<br>PAAPTCEVKSCDDFMGQLLNGRVLFPVNLQLGAKVDFVCDEGFQLKGSSAS<br>YCVLAGMESLWNSSVPVCEQIFCPSPPVIPNGRHTGKPLEVFPFGKTVNYT<br>CDPHPDRGTSFDLIGESTIRCTSDPQGNGVWSSPAPRCGILGHCQAPDHFL<br>FAKLKTQTNASDFPIGTSLKYECRPEYYGRPFSITCLDNLVWSSPKDVCKR<br>KSCKTPPDPVNGMVHVITDIQVGSRINYSCTTGHRLIGHSSAECILSGNAA<br>HWSTKPPICQRIPCGLPPTIANGDFTSTNRENFHYGSVVTYRCNPGSGGRK<br>VFELVGEPSIYCTSNDDQVGIWSGPAPQCIIPNKGGGGSGGGGSGCKPCIC<br>TVPEVSSVFIFPPKPKDVLTITLTPKVTCVVVDISKDDPEVQFSWFVDDVE<br>VHTAQTQPREEQFNSTFRSVSELPIMHQDWLNGKEFKCRVNSAAFPAPIEK<br>TISKTGRPKAPQVYTIPPPKEQMAKDKVSLWCMITDFFPEDITVEWQWNG<br>QPAENYKNTQPIMDTDGSYFVYSKLNVQKSNWEAGNTFTCSVLKEGLHNHH<br>TEKSLSHSPG |
| 91 | CR1 (1-<br>10)-His<br>with TEV<br>cleavage<br>site | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGIWSGPAPQCIIPNKCTPPNVEN<br>GILVSDNRSLFSLNEVVEFRCQPGFVMKGPRRVKCQALNKWEPELPSCSRV<br>CQPPPDVLHAERTQRDKDNfSPGQEVFYSCEPGYDLRGAASMRCTPQGDWS |

US 11,053,305 B2

TABLE 36-continued

SEQUENCE TABLE

| SEQ ID NO: | DESCRIPTION | SEQUENCE |
|---|---|---|
| | | PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPHPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKENLYFQGHHHHHH |
| 92 | CR1 (1-17)-His with TEV cleavage site | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPHPDRGTSFDLIGESIIRCTSDPQGNGVWSSPAPRCGILGHCQAPDHFL FAKLKIQINASDFPIGTSLKYECRPEYYGRPFSITCLDNLVWSSPKDVCKR KSCKTPPDPVNGMVHVITDIQVGSRINYSCIIGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKCTPPNVENGILVSDNRS LFSLNEVVEFRCQPGFvMKGPRRVKCQALNKWEPELPSCSRVCQPPPDVLH AERTQRDKDNFSPGQEVFYSCEPGYDLRGAASMRCTPQGDWSPAAPTCEVK SCDDFMGQLLNGRVLFPVNLQLGAKVDFVCDEGFQLKGSSASYCVLAGMES LWNSSVPVCEQIFCPSPPVIPNGRHIGKPLEVFPFGKAVNYTCDPHPDRGT SFDLIGESTIRCISDPQGNGVWSSPAPRCGILGHCQAPDHFLEAKLKIQIN ASDFPIGTSLKYECRPEYYGRPFSITCLDNLVWSSPKDVCKRKSCKTPPDP VNGMVHVITDIQVGSRINYSCTTGHRLIGHSSAECILSGNTAHWSTKPPIC QRIPCGLPPTIANGDFISTNRENFHYGSVVTYRCNLGSRGRKVFELVGEPS IYCTSNDDQVGIWSGPAPQCIIPNKENLYFQGHHHHHH |
| 93 | Contruct: #1aC2 C2scFv-CR1 (1-10)-His with TEV cleavag site | QVQLQQPGTELVKPGASVKLSCKASGYTFTSYWMHWVKQRPGQGLEWIGNI NPSNGGTNYNEKFKSKATLTVDKSSSTAYMQLSSLTSEDSAVYYCARRGIR LRHFDYWGQGTTLTVSSGGGGSGGGGSGGGGSDIVMTQSHKFKSTSVGDRV SITCKASQDVGTAVAWYQQKPGQSPKLLIYWASTRHTGVPDRFTGSGSGTD FTLTISNVQSEDLADYFCQQYSSYPLTFGAGTKLELKGGGGSGGGGSQCNA PEWLPFARPTNLTDEFEFPIGTYLNYECRPGYSGRPFSIICLKNSVWTGAK DRCRRKSCRNPPDPVNGKVKIGIQFGSQIKYSCTKGYRLIGSSSATCII SGDTVIWDNETPICDRIPCGLPPTITNGDFISTNRENFHYGSVVTYRCNPG SGGRKVFELVGEPSIYCTSNDDQVGIWSGPAPQCIIPNKCTPPNVENGILV SDNRSLFSLNEVVEFRCQPGFVMKGPRRVKCQALNKWEPELPSCSRVCQPP PDVLHAERTQRDKDNFSPGQEVFYSCEPGYDLRGAASMRCTPQGDWSPAAP TCEVKSCDDFMGQLLNGRVLFPVNLQLGAKVDFVCDEGFQLKGSSASYCVL AGMESLWNSSVPVCEQIFCPSPPVIPNGRHTGKPLEVFPFGKTVNYTCDPH PDRGTSFDLIGESTIRCTSDPQGNGVWSSPAPRCGILGHCQAPDKFLFAKL KTQTNASDFPIGTSLKYECRPEYYGRPFSITCLDNLVWSSPKDVCKRKSCK TPPDPVNGMVHVITDIQVGSRINYSCTTGHRLIGKSSAECILSGNAAHWST KPPICQRIPCGLPPTIANGDFISTNRENFKYGSvVTYRCNPGSGGRKVFEL VGEPSIYCTSNDDQVGIWSGPAPQCIIPNKENLYFQGKHHHHH |
| 94 | Contruct: #3C2 C2scFv-Crry-His with TEV cleavage site | QVQLQQPGTELVKPGASVKLSCKASGYTFTSYWMHWVKQRPGQGLEWIGNI NPSNGGTNYNEKFKSKATLTVDKSSSTAYMQLSSLTSEDSAVYYCARRGIR LRKFDYWGQGTTLTVSSGGGGSGGGGSGGGGSDIVMTQSHKFKSTSVGDRV SITCKASQDVGTAVAWYQQKPGQSPKLLIYWASTRHTGVPDRFTGSGSGTD FTLTISNVQSEDLADYFCQQYSSYPLTFGAGTKLELKGGGGSGGGGSCPAP SQLPSAKPINLTDESMFPIGTYLLYECLPGYIKRQFSITCKQDSTWTSAED KCIRKQCKTPSDPENGLVHVHTGIQFGSRINYTCNQGYRLIGSSSAVCVIT DQSVDWDTEAPICEWIPCEIPPGIPNGDFFSSTREDFHYGMVVTYRCNTDA RGKALFNLVGEPSLYCTSNDGEIGVWSGPPPQCIELNKCTPPPYVENAVML SENRSLFSLRDIVEFRCHPGFIMKGASSVHCQSLNKWEPELPSCFKGVICR LPQEMSGFQKGLGMKKEYYYGENVTLECEDGYTLEGSSQSQCQSDGSWNPL LAKCVSRSIENLYFQGHHHHHH |
| 95 | Contruct: #5C2 C2 IgG1 heavy chain-CR1 1-10 | QVQLQQPGTELVKPGASVKLSCKASGYTFTSYWMHWVKQRPGQGLEWIGNI NPSNGGTNYNEKFKSKATLTVDKSSSTAYMQLSSLTSEDSAVYYCARRGIR LRKFDYWGQGTTLTVSSAKTTPPSVYPLAPGSAAQTNSMVTLGCLVKGYFP EPVTVTWNSGSLSSGVHTFPAVLQSDLYTLSSSVTVPSSTWPSETVTCNVA HPASSTKVDKKIVPRDCGCKPCICTVPEVSSVFIFPPKPKDVLTITLTPKV TCVVVDISKDDPEVQFSWFVDDVEVHTAQTQPREEQFNSTFRSVSELPIMH QDWLNGKEFKCRVNSAAFPAPIEKTISKTKGRPKAPQVYTIPPPKEQKAKD KVSLTCMITDFFPEDITVEWQWNGQPAENYKNTQPIMDTDGSYFVYSKLNV QKSNWEAGNTFTCSVLHEGLHNHHTEKSLSHSPGGGGSGGGGSQCNAPEW LPFARPTNLTDEFEFPIGTYLNYECRPGYSGRPFSIICLKNSVWTGAKDRC RRKSCRNPPDPVNGMVHVIKGIQFGSQIKYSCTKGYRLIGSSSATCIISGD TVIWDNETPICDRIPCGLPPTITNGDFISTNRENFHYGSVVTYRCNPGSGG RKVFELVGEPSIYCTSNDDQVGIWSGPAPQCIIPNKCTPPNVENGILVSDN |

TABLE 36-continued

SEQUENCE TABLE

| SEQ ID NO: | DESCRIPTION | SEQUENCE |
|---|---|---|
| | | RSLFSLNEVVEFRCQPGFVMKGPRRVKCQALNKWEPELPSCSRVCQPPPDV<br>LHAERTQRDKDNFSPGQEVFYSCEPGYDLRGAASMRCTPQGDWSPAAPTCE<br>VKSCDDFMGQLLNGRVLFPVNLQLGAKVDFVCDEGFQLKGSSASYCVLAGM<br>ESLWNSSVPVCEQIFCPSPPVIPNGRHTGKPLEVFPFGKTVNYTCDPHPDR<br>GTSFDLIGESTIRCTSDPQGNGVWSSPAPRCGILGHCQAPDHFLFAKLKTQ<br>TNASDFPIGTSLKYECRPEYYGRPFSITCLDNLVWSSPKDVCKRKSCKTPP<br>DPVNGMVHVITDIQVGSRINYSCTTGHRLIGHSSAECILSGNAAHWSTKPP<br>ICQRIPCGLPPTIANGDFISTNRENFHYGSVVTYRCNPGSGGRKVFELVGE<br>PSIYCTSNDDQVGIWSGPAPQCIIPNK |
| 96 | Construct:<br>#5C2<br>C2 IgG1<br>heavy<br>chain-<br>CR1 1-10 | QVQLQQPGTELVKPGASVKLSCKASGYTFTSYWKHWVKQRPGQGLEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGCKPCICTVPEVSSVFIFPPKPKDVLTITLTPKV<br>TCVVVDISKDDPEVQFSWFVDDVEVHTAQTQPREEQFNSTFRSVSELPIMH<br>QDWLNGKEFKCRVNSAAFPAPIEKTISKTKGRPKAPQVYTIPPPKEQMAKD<br>KVSLTCMITDFFPEDITVEWQWNGQPAENYKNTQPIMDTDGSYFVYSKLNV<br>QKSNWEAGNTFTCSVLHEGLHNHHTEKSLSHSPGGGGGSGGGGSQCNAPEW<br>LPFARPTNLTDEFEFPIGTYLNYECRPGYSGRPFSIICLKNSVWTGAKDRC<br>RRKSCRNPPDPVNGMVHVIKGIQFGSQIKYSCTKGYRLIGSSSATCIISGD<br>TVIWDNETPICDRIPCGLPPTITNGDFISTNRENFKYGSVVTYRCNPGSGG<br>RKVFELVGEPSIYCTSNDDQVGIWSGPAPQCIIPNKCTPPNVENGILVSDN<br>RSLFSLNEVVEPRCQPGFVMKGPRPVKCQALNKWEPELPSCSRVCQPPPDV<br>LHAERTQRDKDNFSPGQEVFYSCEPGYDLRGAASMRCTPQGDWSPAAPTCE<br>VKSCDDFMGQLLNGRVLFPVNLQLGAKVDFVCDEGFQLKGSSASYCVIAGM<br>ESLWNSSVPVCEQIFCPSPPVIPNGRHTGKPLEVFPFGKTVNYTCDPHPDR<br>GTSFDLIGESTIRCTSDPQGNGVWSSPAPRCGILGHCQAPDHFLFAKLKTQ<br>TNASDFPIGTSLKYECRPEYYGRPFSITCLDNLVWSSPKDVCKRKSCKTPP<br>DPVNGKVHVITDIQVGSRISTSCTTGKRLIGHSSAECILSGNAAQWSTKPP<br>ICQRIPCGLPPTIANGDFISTNRENFHYGSVVTYRCNPGSGGRKVFELVGE<br>PSIYCTSNDDQVGIWSGPAPQCIINK |
| 97 | Construct:<br>#5C2<br>C2 IgG1<br>heavy<br>chain-<br>(hole)-<br>CR1 1-10<br>[pairs with<br>#6C2 knob)] | QVQLQQPGTELVKPGASVKLSCKASGYTFTSYWMHWVKQRPGQGLEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGCKPCICTVPEVSSVFIFPPKPKDVLTITLTPKV<br>TCVVVDISKDDPEVQFSWFVDDVEVHTAQTQPREEQFNSTFRSVSELPIMH<br>QDWLNGKEFKCRVNSAAFPAPIEKTISKTKGRPKAPQVYTIPPPKEQMAKD<br>KVSLSCAITDFFPEDITVEWQWNGQPAENYKNTQPIMDTDGSYFVVSKLNV<br>QKSNWEAGNTFTCSVLHEGLKNHHTEKSLSHSPGGGGGSGGGGSQCNAPEW<br>LPFARPTNLTDEFEFPIGTYLNYECRPGYSGRPFSIICLKNSVWTGAKDRC<br>RRKSCRNPPDPVNGMVHVIKGIQFGSQIKYSCTKGYRLIGSSSATCIISGD<br>TVIWDNETPICDRIPCGLPPTITNGDFISTNRENFHYGSVVTYRCNPGSGG<br>RKVFELVGEPSIYCTSNDDQVGIWSGPAPQCIIPNKCTPPNVENGILVSDN<br>RSLFSLNEVVEFRCQPGFVMKGPRRVKCQALNKWEPELPSCSRVCQPPPDV<br>LHAERTQRDKDKFSPGQEVFYSCEPGYDLRGAASMRCTPQGDWSPAAPTCE<br>VKSCDDFMGQLLNGRVLFPVNLQLGAKVDFVCDEGFQLKGSSASYCVLAGM<br>ESLWNSSVPVCEQIFCPSPPVIPNGRHTGKPLEVFPFGKTVNYTCDPHPDR<br>GTSFDLIGESTIRCTSDPQGNGVWSSPAPRCGILGHCQAPDHFLFAKLKTQ<br>TNASDFPIGTSLKYECRPEYYGRPFSITCLDNLVWSSPKDVCKRKSCKTPP<br>DPVNGMVHVITDIQVGSRINYSCTTGHRLIGHSSAECILSGNAAHWSTKPP<br>ICQRIPCGLPPTIANGDFISTNRENFKYGSWTYRCNPGSGGRKVFELVGE<br>PSIYCTSNDDQVGIWSGPAPQCIIPNK |
| 98 | Construcct:<br>#6C2<br>C2 IgG1<br>heavy<br>chain | QVQLQQPGTELVKPGASVKLSCKASGYTFTSYWMHWVKQRPGQGLEWIGNI<br>NPSNGGTNYNEKFKSKATLTVDKSSSTAYMQLSSLTSEDSAVYYCARRGIR<br>LRKFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGCKPCICTVPEVSSVFIFPPKPKDVLTITLTPKV<br>TCVVVDISKDDPEVQFSWFVDDVEVHTAQTQPREEQFNSTFRSVSELPIMH<br>QDWLNGKEFKCRVNSAAFPAPIEKTISKTKGRPKAPQVYTIPPPKEQMAKD<br>KVSLTCMITDFFPEDITVEWQWNGQPAENYKNTQPIMDTDGSYFVYSKLNV<br>QKSNWEAGNTFTCSVLHEGLHNHHTEKSLSHSPG |
| 99 | Contstruct:<br>#6C2<br>(knob)<br>C2 IgG1<br>heavy<br>chain<br>(knob)<br>[pairs with<br>#5C2<br>hole)] | QVQLQQPGTELVKPGASVKLSCKASGYTFTSYWMKWVKQRPGQGLEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGCKPCICTVPEVSSVFIFPPKPKDVLTITLTPKV<br>TCVVVDISKDDPEVQFSWFVDDVEVHTAQTQPREEQFNSTFRSVSELPIMH<br>QDWLNGKEFKCRVNSAAFPAPIEKTISKTKGRPKAPQVYTIPPPKEQMAKD<br>KVSLWCMITDFFPEDITVEWQWNGQPAENYKNTQPIMDTDGSYFVYSKLNV<br>QKSNWEAGNTFTCSVLHEGLHNHHTEKSLSHSPG |

US 11,053,305 B2
163      164

TABLE 36-continued

SEQUENCE TABLE

| SEQ ID NO: | DESCRIPTION | SEQUENCE |
|---|---|---|
| 100 | Construct:<br>#7C2<br>C2 IgG1<br>Fab heavy<br>chain-<br>Crry | QVQLQQPGTELVKPGASVKLSCKASGYTFTSYWMHWVKQRPGQGLEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGGGGSGGGGSCPAPSQLPSAKPINLTDESKFPI<br>GTYLLYECLPGYIKRQFSITCKQDSTWTSAEDKCIRKQCKTPSDPENGLVH<br>VHTGIQFGSRINYTCNQGYRLIGSSSAVCVITDQSVDWDTEAPICEWIPCE<br>IPPGIPNGDFFSSTREDFKYGMVVTYRCNTDARGKALFNLVGEPSLYCTSN<br>DGEIGVWSGPPPQCIELNKCTPPPYVENAVKLSENRSLFSLRDIVEFRCHP<br>GFIMKGASSVHCQSLNKWEPELPSCFKGVTCRLPQEMSGFQKGLGMKKEYY<br>YGENVTLECEDGYTLEGSSQSQCQSDGSWNPLLAKCVSRSI |
| 101 | Construct:<br>#8aC2<br>C2 IgG1<br>Fab heavy<br>chain-<br>CR1 1-10 | QVQLQQPGTELVKPGASVKLSCKASGYTFTSYWMHWVKQRPGQGLEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGGGGSGGGGSQCNAFEWLPFARPTNLTDEFEFP<br>IGTYLNYECRPGYSGRPFSIICLKNSVWTGAKDRCRRKSCRNPPDPVNGMV<br>HVIKGIQFGSQIKYSCTKGYRLIGSSSATCIISGDTVIWDNETPICDRIPC<br>GLPPTITNGDFISTNRENFHYGSVVTYRCNPGSGGRKVFELVGEPSIYCTS<br>NDDQVGIWSGPAPQCIIPNKCTPPNVENGILVSDNRSLFSLNEVVEFRCQP<br>GFVMKGPRRVKCQALNKWEPELPSCSRVCQPPPDVLKAERTQRDKDNFSPG<br>QEVFYSCEPGYDLRGAASMRCTPQGDWSPAAPTCEVKSCDDFMGQLLNGRV<br>LFPVNLQLGAKVDFVCDEGFQLKGSSASYCVLAGMESLWNSSVPVCEQIFC<br>PSPPVIPNGRHTGKPLEVFPFGKTVNYTCDPHPDRGTSFDLIGESTIRCTS<br>DPQGNGVWSSPAPRCGILGHCQAPDHFLFAKLKTQTNASDFPIGTSLKYEC<br>RPEYYGRPFSITCLDNLVWSSPKDVCKRKSCKTPPDPVNGMVHVITDIQVG<br>SRINYSCTTGHRLIGHSSAECILSGNAAHWSTKPPICQRIPCGLPPTIANG<br>DFISTNRENFHYGSVVTYRCNPGSGGRKVFELVGEPSIYCTSNDDQVGIWS<br>GPAPQCIIPNK |
| 102 | Construct:<br>#8bC2<br>C2 IgG1<br>Fab heavy<br>chain-<br>CR1 1-17 | QVQLQQPGTELVKPGASVKLSCKASGYTFTSYWMHWVKQRPGQGLEWIGMI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGGGGSGGGGSQCNAPEWLPFARPTNLTDEFEFP<br>IGTYLNYECRPGYSGRPFSIICLKNSVWTGAKDRCRRKSCRNPPDPVNGMV<br>HVIKGIQFGSQIKYSCTKGYRLIGSSSATCIISGDTVIWDNETPICDRIPC<br>GLPPTITNGDFISTNRENFHYGSVVTYRCNPGSGGRKVFELVGEPSIYCTS<br>NDDQVGIWSGPAPQCIIPNKCTPPNVENGILVSDNRSLFSLNEVVEFRCQP<br>GFVMKGPRRVKCQALNKWEPELPSCSRVCQPPPDVLHAERTQRDKDNFSPG<br>QEVFYSCEPGYDLRGAASMRCTPQGDWSPAAPTCEVKSCDDFKGQLLNGRV<br>LFPVNLQLGAKVDFVCDEGFQLKGSSASYCVLAGMESLWNSSVPVCEQIFC<br>PSPPVIPNGRHTGKPLEVFPFGKTVNYTCDPHPDRGTSFDLIGESTIRCTS<br>DPQGNGVWSSPAPRCGILGHCQAPDHFLFAKLKTQTNASDFPIGTSLKYEC<br>RPEYYGRPFSITCLDNLVWSSPKDVCKRKSCKTPPDPVNGMVHVITDIQVG<br>SRINYSCTTGHRLIGHSSAECILSGNAAHWSTKPPICQRIPCGLPPTIANG<br>DFISTNRENFHYGSVVTYRCNPGSGGREVFEINGEPSIYCISNDDQVGIWS<br>GPAPQCIIPNKCTPPNVENGILVSDNRSLFSLNEVVEFRCQPGFVMKGPRR<br>VKCQALNKWEPELPSCSRVCQPPPDVLHAERTQRDKDNFSPGQEVFYSCEP<br>GYDLRGAASMRCIPQGDWSPAAPICEVYSCDDFMGQLLNGRVLFPVNLQLG<br>AKVDFVCDEGFQLKGSSASYCVLAGMESLWNSSVPVCEQIFCPSPPVIPNG<br>RHTGKPLEVFPFGKAVNYTCDPHPDRGTSFDLIGESTIRCTSDPQGNGVWS<br>SPAPRCGILGHCQAPDHFLFAKLKTQINASDFPIGTSLKYECRPEYYGRPF<br>SITCLDNLVWSSPKDVCKRKSCKTPPDPVNGMVHVIIDIQVGSRINYSCTT<br>GHRLIGHSSAECILSGNTAHWSTKPPICQRIPCGLPPTIANGDFISTNREN<br>FHYGSVVTYRCNLGSRGRKVFELVGEPSIYCTSNDDQVGIWSGPAPQCIIP<br>NK |
| 103 | Construct:<br>#10C2<br>(hole)<br>CR1 1-10-<br>IgG1 Fc<br>(hole)<br>[pairs<br>with #6C2<br>(knob)] | QCNAPEWLPFARPINLIDEFEFPIGTYLNYECRPGYSGRPFSIICLKNSVW<br>TGAKDRCRRKSCRNPPDPVNGMVHVIKGIQFGSQIKYSCIKGYRLIGSSSA<br>ICIISGDTVIWDNEIPICDRIPCGLPPTITNGDFISTNRENFHYGSVVIYR<br>CNPGSGGRKVFELVGEPSIYCISNDDQVGIWSGPAPQCIIPNKCTPPNVEN<br>GILVSDNRSLFSLNEVVEFRCQPGFVMKGPRRVKCQAINKWEPELPSCSRV<br>CQPPPDVLHAERTQRDKDNFSPGQEVFYSCEPGYDLRGAASMRCIPQGDWS<br>PAAPICEVKSCDDFMGQLLNGRVLFPVNLQLGAKVDFVCDEGFQLKGSSAS<br>YCVLAGMESLWNSSVPVCEQIFCPSPPVIPNGRHTGKPLEVFPFGETVNYI<br>CDPHPDRGTSFDLIGESTIRCTSDPQGNGVWSSPAPRCGILGHCQAPDHFL<br>FAKLKTQTNASDFPIGTSLKYECRPEYYGRPFSITCLDNLVWSSPKDVCKR<br>KSCKTPPDPVNGMVHVITDIQVGSRINYSCTTGHRLIGHSSAECILSGNAA<br>HWSTKPPICQRIPCGLPPTIANGDFISTNRENFHYGSVVTYRCNPGSGGRK<br>VFELVGEPSIYCTSNDDQVGIWSGPAPQCIIPNKGGGGSGGGGSGCKPCIC<br>TVPEVSSVFIFPPKPKDVLTITLTPKVTCVVVDISKDDPEVQFSWFVDDVE<br>VHTAQTQPREEQFNSTFRSVSELPIMHQDWLNGKEFKCRVNSAAFPAPIEK<br>TISKTKGRPKAPQVYTIPPPKEQMAKDKVSLSCAITDFFPEDITVEWQWNG |

TABLE 36-continued

SEQUENCE TABLE

| SEQ ID NO: | DESCRIPTION | SEQUENCE |
| --- | --- | --- |
|  |  | QPAENYKNTQPIMDTDGSYFVVSKLNVQKSNWEAGNTFTCSVLHEGLHNHH<br>TEKSLSHSPG |
| 104 | Construct:<br>#11C2<br>(hole)<br>CR1 1-10-<br>C2 IgG1<br>heavy chain<br>(hole [pairs<br>with<br>#6C2<br>(knob)] | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGIWSGPAPQCIIPNKCTPPNVEN<br>GILVSDNRSLFSLNEVVEFRCQPGFVMKGPRRVKCQALNKWEPELPSCSRV<br>CQPPPDVLHAERTQRDKDNFSPGQEVFYSCEPGYDLRGAASMRCTPQGDWS<br>PAAPTCEVKSCDDFMGQLLNGRVLFPVNLQLGAKVDFVCDEGFQLKGSSAS<br>YCVLAGMESLWNSSVPVCEQIFCPSPPVIPNGRHTGKPLEVFPFGKTVNYT<br>CDPKPDRGTSFDLIGESTIRCTSDPQGNGVWSSPAPRCGILGHCQAPDHFL<br>FAKLKTQTNASDFPIGTSLKYECRPEYYGRPFSITCLDNLVWSSPKDVCKR<br>KSCKTPPDPVNGMVHVITDIQVGSRINYSCTTGHRLIGHSSAECILSGNAA<br>HWSTKPPICQRIPCGLPPTIANGDFISTNRENFHYGSVVTYRCNPGSGGRK<br>VFELVGEPSIYCTSNDDQVGIWSGPAPQCIIPNKGGGSGGGGSQVQLQQP<br>GTELVKPGASVKLSCKASGYTFTSYWMHWVKQRPGQGLEWIGNINPSNGGT<br>NYNEKFKSKATLTVDKSSSTAYMQLSSLTSEDSAVYYCARRGIRLRRFDYW<br>GQGTTLTVSSAKTTPPSVYPLAPGSAAQTNSMVTLGCLVKGYFPEPVTVTW<br>NSGSLSSGVHTFPAVLQSDLYTLSSSVTVPSSTWPSETVTCNVAHPASSTK<br>VDKKIVPRDCGCKPCICTVPEVSSVFIFPPKPKDVLTITLTPKVTCVVVDI<br>SKDDPEVQFSWFVDDVEVHTAQTQPREEQFNSTFRSVSELPIMHQDWLNGK<br>EFKCRVNSAAFPAPIEKTISKTKGRPKAPQVYTIPPPKEQMAKDKVSLSCA<br>ITDFFPEDITVEWQWNGQPAENYKNTQPIMDTDGSYFVVSKLNVQKSNWEA<br>GNTFTCSVLHEGLHNHHTEKSLSHSPG |
| 105 | Construct:<br>#12aC2<br>CR1 1-10-<br>C2 IgG1<br>Fab heavy<br>chain | QCNAPEWLPFARPINLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNEIPICDRIPCGLPPIITNGDFISTNRENFHYGSVVIYR<br>CNPGSGGRKVFELVGEPSIYCTSNDDQVGIWSGPAPQCIIPNKCTPPNVEN<br>GILVSDNRSLFSLNEVVEFRCQPGFVMKGPRRVKCQALNKWEPELPSCSRV<br>CQPPPDVLHAERIQRDKDNFSPGQEVFYSCEPGYDLRGAASMRCTPQGDWS<br>PAAPTCEVKSCDDFMGQLLNGRVLFPVNLQLGAKVDFVCDEGFQLKGSSAS<br>YCVLAGMESLWNSSVPVCEQIFCPSPPVIPNGRHTGEPLEVFPFGKTVNYI<br>CDPHPDRGTSFDLIGESIIRCTSDPQGNGVWSSPAPRCGILGHCQAPDHFL<br>FAKLKTQINASDFPIGTSLKYECRPEYYGRPFSIICLDNLVWSSPKDVCKR<br>KSCKTPPDPVNGMVHVIIDIQVGSRINYSCTTGHRLIGHSSAECILSGNAA<br>HWSTKPPICQRIPCGLPPTIANGDFISNRENFHYGSVVIYRCNPGSGGRK<br>VFELVGEPSIYCTSNDDQVGIWSGPAPQCIIPNKGGGSGGGGSQVQLQQP<br>GTELVKPGASVKLSCKASGYTFTSYWMHWVKQRPGQGLEWIGNINPSNGGT<br>NYNEKFKSKATLTVDKSSSTAYMQLSSITSEDSAVYYCARRGIRLRHETYW<br>GQGTTLTVSSAKTTPPSVYPLAPGSAAQTNSMVTLGCLVKGYEPEPVTVTW<br>NSGSLSSGVHTFPAVLQSDLYTLSSSVTVPSSTWPSETVTCNVAHPASSTK<br>VDKKIVPRDCG |
| 106 | Construct:<br>#12bC2<br>CR1 1-17<br>C2 IgG1<br>Fab heavy<br>chain | QCNAPEWLPFARPTNLTDEFEFPIGTYLNYECRPGYSGRPFSIICLKNSVW<br>TGAKDRCRRKSCRNPPDPVNGMVHVIKGIQFGSQIKYSCTKGYRLIGSSSA<br>TCIISGDTVIWDNETPICDRIPCGLPPTITNGDFISTNRENFHYGSVVTYR<br>CNPGSGGRKVFELVGEPSIYCTSNDDQVGIWSGPAPQCIIPNKCTPPNVEN<br>GILVSDNRSIFSLNEVVEFRCQPGFVMKGPRRVKCQALNKWEPELPSCSRV<br>CQPPPDVLHAERTQRDKDNFSPGQEVFYSCEPGYDLRGAASMRCTPQGDWS<br>PAAPTCEVKSCDDFMGQLLNGRVLFPVNLQLGAKVDFVCDEGFQLKGSSAS<br>YCVLAGMESLWNSSVPVCEQIFCPSPPVIPNGRHTGKPLEVFPFGKTVNYT<br>CDPHPDRGTSFDLIGESTIRCTSDPQGNGVWSSPAPRCGILGHCQAPDHFL<br>FAEIKTQTNASDFPIGTSLKYECRPEYYGRPFSITCLDNLVWSSPKDVCKR<br>KSCKTPPDPVNGMVHVITDIQVGSRINYSCTTGHRLIGHSSAECILSGNAA<br>HWSTKPPICQRIPCGLPPTIANGDFISTNRENFHYGSVVTYRCNPGSGGRK<br>VFELVGEPSIYCTSNDDQVGIWSGPAPQCIIPNRCTPPNVENGILVSDNRS<br>LFSINEVVEFRCQPGFVMKGPRRVKCQALNKWEPELPSCSRVCQPPPDVLH<br>AERTQRDKDNFSPGQEVEYSCEPGYDLRGAASMRCTPQGDWSPAAPTCEVK<br>SCDDFMGQIINGRVLFPVNLQLGAKVDEVCDEGFQLKGSSASYCVLAGMES<br>LWNSSVPVCEQIFCPSPPVIPNGRHTGKPLEVFPFGKAVNYTCDPHPDRGT<br>SFDLIGESTIRCTSDPQGNGVWSSPAPRCGILGHCQAPDHFLFAKLKTQTN<br>ASDFPIGTSLKYECRPEYYGRPFSITCLDNLVWSSPKDVCKRKSCKTPPDP<br>VNGMVHVITDIQVGSRINYSCTTGHRLIGHSSAECILSGNTAHNSTKPPIC<br>QRIPCGLPPTIANGDFISTNRENFHYGSVVTYRONLGSRGRKVFELVGEPS<br>IYCTSNDDQVGIWSGPAPQCIIPNKGGGSGGGGSQVQLQQPGTELVKPGA<br>SVKLSCKASGYTFTSYWMHWVKQRPGQGLEWIGNINPSNGGTNYNEKFKSK<br>ATLTVDKSSSTAYMQLSSLTSEDSAVYYCARRGIRLRHFDYWGQGTTLTVS<br>SAKTTPPSVYPLAPGSAAQTNSMVTLGCLVKGYFPEPVTVTWNSGSLSSGV<br>HTFPAVLQSDLYTLSSSVTVPSSTWPSETVTCNVAHPASSTKVDKKIVPRD<br>CG |

US 11,053,305 B2

TABLE 36-continued

SEQUENCE TABLE

| SEQ ID NO: | DESCRIPTION | SEQUENCE |
|---|---|---|
| 107 | Construct: #13C2 CR1 1-10-C2 kappa light chain | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFEINGEPSIYCTSNDDQVGIWSGPAPQCIIPNKCIPPNVEN GILVSDNRSLFSINEVVEFRCQPGFVMKGPRRVKCQALNKWEPELPSCSRV CQPPPDVLHAERTQRDKDNFSPGQEVEYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPPFGKTVNYT CDPHPDRGTSFDLIGESTIRCTSDPQGNGVWSSPAPRCGILGECQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSDIVMTQS HKFMSTSVGDRVSITCKASQDVGTAVAWYQQKPGQSPKLLIYWASTRHTGV PDRFTGSGSGTDETLTISNVQSEDLADYFCQQYSSYPLTFGAGTKLELKRA DAAPTVSIFPPSSEQLTSGGASVVCFLNNFYPKDINVKWKIDGSERQNGVL NSWTDQDSKDSTYSMSSTLTLTKDEYERHNSYTCEATHKTSTSPIVKSFNR NEC |
| 108 | Factor H (1-5)-His with TEV cleavage site | EDCNELPPRRNTEILTGSWSDQTYPEGTQATYKORPGYRSIGNVIMVCRKG EWVALNPIRKCQKRPCGHPGDTPFGTFTLTGGNVFEYGVKAVYTCNEGYQL LGEINYRECDTDGWTNDIPICEVVKCLPVTAPENGKIVSSAMEPDREYHFG QAVRFVCNSGYKIEGDEEMHCSDDGFWSKEKPKCVEISCKSPDVINGSPIS QKIIYKENERFQYKCNMGYEYSERGDAVCTESGWRPLPSCEEKSCDNPYIP NGDYSPLRIKHRTGDEITYQCRNGFYPATRGNTAKCTSTGWIPAPRCTLKE NLYFQGHHHHHH |
| 109 | 3d29 Fab heavy chain murine IgG1 Crry-His with TEV cleavage site | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSESSGVHTFPAVLQSDLYTESSSVTVPSSTWPSETVTCNVAHPASST KVDKKIVPRDCGGGGSGGGGSCPAPSQLPSAKPINLTDESMFPIGTYLLY ECLPGYIKRQFSITCKQDSTWTSAEDKCIRKQCKTPSDPENGLVHVHTGIQ FGSRINYTCNQGYRLIGSSSAVCVITDQSVDWDTEAPICEWIPCELPPGIP NGDFFSSTREDFHYGMVVTYRCNTDARGKALFNLVGEPSLYCTSNDGEIGV WSGPPPQCIELNKCTPPPYVENAVMLSENRSLFSLRDIVEFRCHPGFIMKG ASSVHCQSLNKWEPELPSCFKGVICRLPQEMSGFQKGLGMKKEYYYGENVT LECEDGYTLEGSSQSQCQSDGSWNPLLAKCVSRSIENLYFQGHHHHHH |
| 110 | 3d29 Fab heavy chain murine IgG1-CR1 1-10-His with TEV cleavage site | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGGGGSGGGGSQCNAPEWLPFARPTNLTDEFEFPIGTYLN YECRPGYSGRPFSIICLKNSVWTGAKDRCRRKSCRNPPDPVNGMVRVIKGI QFGSQIKYSCTKGYRLIGSSSATCIISGDTVIWDNETPICDRIPCGLPPTI TNGDFISTNRENFHYGSVVTYRCNPGSGGRKVFELVGEPSIYCTSNDDQVG IWSGPAPQCIIPNKCTPPNVENGILVSDNRSLFSLNEVVEFRCQPGFVMKG PRRVKCQALNKWEPELPSCRVCQPPPDVLHAERTQRDKDNFSPGQEVFYS CEPGYDLRGAASMRCTPQGDWSPAAPTCEVKSCDDFMGQLLNGRVLFPVNL QLGAKVDFVCDEGFQLKGSSASYCVLAGMESLWNSSVPVCEQIFCPSPPVI PNGRHTGKPLEVFPPFGKTVNYTCDPHPDRGTSFDLIGESTIRCTSDPQGNG VWSSPAPRCGILGHCQAPDHFLFAKLKTQTNASDFPIGTSLKYECRPEYYG RPFSITCLDNLVWSSPKDVCKRKSCKTPPDPVNGMVHVITDIQVGSRINYS CTTGKRLIGHSSAECILSGNAAHWSTKPPICQRIPCGLPPTIANGDFISTN RENFHYGSVVTYRCNPGSGGRKVFELVGEPSIYCTSNDDQVGIWSGPAPQC IIPNKENLYFQGHHHHHH |
| 111 | 3d29 Fab heavy chain murine IgG1-fH 1-5 with TEV cleavage site | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGGGGSGGGGSEDCNELPPRRNTEILTGSWSDQTYPEGTQ AIYKCRPGYRSLGNVIMVCRKGEWVALNPLRKCQKRPCGHPGDTPFGTFTL TGGNVFEYGVKAVYTCNEGYQLLGEINYRECDTDGWTNDIPICEVVKCLPV TAPENGKIVSSAMEPDREYKFGQAVRFVCNSGYKIEGDEEMHCSDDGFWSK EKPKCVEISCKSPDVINGSPISQKIIYKENERFQYKCNMGYEYSERGDAVC TESGWRPLPSCEEKSCDMPYIPNGDYSPLRIKHRTGDEITYQCRNGFYPAT RGNTAKCTSTGWIPAPRCTLKENLYFQGHHHHHH |
| 112 | 3d29 heavy chain murine IgG1 (knob) | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMHQDWLNG |

TABLE 36-continued

SEQUENCE TABLE

| SEQ ID NO: | DESCRIPTION | SEQUENCE |
|---|---|---|
| | | KEFKCRVNSAAFPAPIEKTISKTKGRPKAPQVYTIPPPKEQKAKDKVSLWC<br>MITDFFPEDITVEWQWNGQPAENYKNTQPIMDTDGSYFVYSKLNVQKSNWE<br>AGNTFTCSVLHEGLHNHHTEKSLSHSPG |
| 113 | 3d29 heavy chain murine IgG1 (hole)-fH 1-5-His with TEV cleavage site | EVQLQQSGPVLVKPGASVKMSCKASGYTFTDYYMNWVKQSHGKSLEWIGVI<br>NPYNGGTSYNQKFKGKATLTVDKSSRTAYMELNSLTSEDSAVYYCSRGGPY<br>WGQGTTLTVSSAKTTPPSVYPIAPGSAAQTNSMVTLGCLVKGYFPEPVTVT<br>WNSGSLSSGVHTFPAVLQSDLYTLSSSVTVPSSTWPSETVTCNVAKPASST<br>KVDKKIVPRDCGCKPCICTVPEVSSVFIFPPKPKDVLTITLTPKVTCVVVD<br>ISKDDPEVQFSWFVDDVEVKTAQTQPREEQFNSTFRSVSELPIMHQDWLNG<br>KEFKCRVNSAAFPAPIEKTISKTKGRPKAPQVYTIPPPKEQKAKDKVSLSC<br>AITDFFPEDITVEWQWNGQPAENYKNTQPIMDTDGSYFVVSKLNVQKSNWE<br>AGNTFTCSVLHEGLHNHHTEKSLSHSPGGGGSGGGGSEDCNELPPRRKTE<br>ILTGSWSDQTYPEGTQAIYKCRPGYRSLGNVIMVCRKGEWVALNPLRKCQK<br>RPCGHPGDTPFGTFTLTGGNVFEYGVKAVYTCNEGYQLLGEINYRECDTDG<br>WTNDIPICEVVKCLPVTAPENGKIVSSAMEPDREYHFGQAVRFVCNSGYKI<br>EGDEEMHCSDDGFWSKEKPKCVEISCKSPDVINGSPISQKIIYKENERFQY<br>KCNMGYEYSERGDAVCTESGWRPLPSCEEKSCDNPYIPNGDYSPLRIKHRT<br>GDEITYQCRNGFYPATRGNTAKCTSTGWIPAPRCTLK<u>ENLYFQ</u>GHHHHHH |
| 114 | 3d29 heavy chain murine IgG1-fH 1-5-His with TEV cleavage site | EVQLQQSGPVLVKPGASVKMSCKASGYTFTDYYMNWVKQSHGKSLEWIGVI<br>NPYNGGTSYNQKFKGKATLTVDKSSRTAYMELNSLTSEDSAVYYCSRGGPY<br>WGQGTTLTVSSAKTTPPSVYPLAPGSAAQTNSMVTLGCLVKGYFPEPVTVT<br>WNSGSLSSGVHTFPAVLQSDLYTLSSSVTVPSSTWPSETVTCNVAKPASST<br>KVDKKIVPRDCGCKPCICTVPEVSSVFIFPPKPKDVLTITLTPKVTCVVVD<br>ISKDDPEVQFSWFVDDVEVHTAQTQPREEQFNSTFRSVSELPIMHQDWLNG<br>KEFKCRVNSAAFPAPIEKTISKTKGRPKAPQVYTIPPPKEQMAKDKVSLTC<br>MITDFFPEDITVEWQWNGQPAENYKNTQPIMDTDGSYFVYSKLNVQKSNWE<br>AGNTFTCSVLHEGLHNHHTEKSLSHSPGGGGSGGGGSEDCNELPPRRNTE<br>ILTGSWSDQTYPEGTQAIYKCRPGYRSLGNVIMVCRKGEWVALNPLRKCQK<br>RPCGHPGDTPFGTFTLTGGNVFEYGVKAVYTCNEGYQLLGEINYRECDTDG<br>WTNDIPICEVVKCLPVTAPENGKIVSSAMEPDREYHFGQAVRFVCNSGYKI<br>EGDEEMHCSDDGFWSKEKPKCVEISCKSPDVINGSPISQKIIYKENERFQY<br>KCNMGYEYSERGDAVCTESGWRPLPSCEEKSCDNPYIPNGDYSPLRIKHRT<br>GDEITYQCRNGFYPATRGNTAKCTSTGWIPAPRCTLK<u>ENLYFQ</u>GHHHHHH |
| 115 | 3d8b Fab heavy chain murine IgG1-Crry with TEV cleavage site | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSKVTLGCLVKGYFPEPVTVTWN<br>SGSLSSGVHTFPAVLQSDLYTLSSSVTVPSSTWPSETVTCNVAKPASSTKV<br>DKKIVPRDCGGGGSGGGGSCPAPSQLPSAKPINLTDESMFPIGTYLLYEC<br>LPGYIKRQFSITCKQDSTWTSAEDKCIRKGCKTPSDPENGLVHVHTGIQFG<br>SRINYTCNQGYRLIGSSSAVCVITDQSVDWDTEAPICEWIPCEIPPGIPNG<br>DFFSSTREDFHYGMVVTYRCNTDARGKALFNLVGEPSLYCTSNDGEIGVWS<br>GPPPQCIELNKCTPPPYVENAVMLSENRLFSLRDIVEFRCHPGFIMKGAS<br>SVHCQSLNKWEPELPSCFKGVICRLPQEMSGFQKGLGMKKEYYYGENVTLE<br>CEDGYTLEGSSQSQCQSDGSWNPLLAKCVSRSI<u>ENLYFQ</u>GHHHHHK |
| 116 | 3d8b Fab heavy chain murine IgG1-CR1 1-10-His with TEV cleavage site | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGGGGSGGGGSQCNAPEWLPFARPTNLTDEFEFPIGTYLNYE<br>CRPGYSGRPFSIICLKNSVWTGAKDRCRRKSCRNPPDPVNGMVHVIKGIQF<br>GSQIKYSCTKGYRLIGSSSATCIISGDTVIWDNETPICDRIPCGLPPTITN<br>GDFISTNRENFHYGSVVTYRCNPGSGGRKVFELVGEPSIYCTSNDDQVGIW<br>SGPAPQCIIPNKCTPPNVENGILVSDNRSLFSLNEVVEFRCQPGFVMKGPR<br>RVKCQALNKWEPELPSCSRVCQPPPDVLHAERTQRDKDNFSPGQEVFYSCE<br>PGYDLRGAASMRCTPQGDWSPAAPTCEVKSCDDFMGQLLNGRVLFPVNLQL<br>GAKVDFVCDEGFQLKGSSASYCVLAGMESLWNSSVPVCEQIFCPSPPVIPN<br>GRHTGKPLEVPFPFGKTVNYTCDPHPDRGTSFDLIGESTIRCTSDPQGNGVW<br>SSPAPRCGILGKCQAPDHFLFAKLKTQTNASDFPIGTSLKYECRPEYYGRP<br>FSITCLDNLVWSSPKDVCKRKSCKTPPDPVNGMVHVITDIQVGSRINYSCT<br>TGKRLIGHSSAECILSGNAAHWSTKPPICQRIPCGLPPTIANGDFISTNRE<br>NFHYGSVVTYRCNPGSGGRKVFELVGEPSIYCTSNDDQVGIWSGPAPQCII<br>PNK<u>ENLYFQ</u>GHHHHHH |
| 117 | 3d8b Fab heavy chain murine IgG1-fH 1-5-His with TEV cleavage site | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGGGGSGGGGSEDCNELPPRRNTEILTGSWSDQTYPEGTQAI<br>YKCRPGYRSLGNVIMVCRKGEWVALNPLRKCQKRPCGHPGDTPFGTFTLTG<br>GNVFEYGVKAVYTCNEGYQLLGEINYRECDTDGWTNDIPICEVVKCLPVTA<br>PENGKIVSSAMEPDREYHFGQAVRFVCNSGYKIEGDEEMHCSDDGFWSKEK |

TABLE 36-continued

SEQUENCE TABLE

| SEQ ID NO: | DESCRIPTION | SEQUENCE |
|---|---|---|
| | | PKCVEISCKSPDVINGSPISQKIIYKENERFQYKCNMGYEYSERGDAVCTE SGWRPLPSCEEKSCDNPYIPNGDYSPLRIKHRTGDEITYQCRNGFYPATRG NTAKCTSTGWIPAPRCTLKENLYFQGHHHHHH |
| 118 | 3d8b kappa light chain-CR1 1-10-His with TEV cleavage site | DVVMTQTPLTLSVTIGQPASISCKSSQSLLDSDGKTYLNWLLQRPGQSPKR LIYLVSKLDSGVPDRFTGSGSGTDFTLKISRVEAEDLGVYYCWQGTHFPRT FGGGTKLEIRRADAAPTVSIFPPSSEQLTSGGASVVCFLNNFYPKDINVKW KIDGSERQNGVLNSWTDQDSKDSTYSMSSTLTLTKDEYERHNSYTCEATHK TSTSPIVKSFNRNECGGGGSGGGGSQCNAPEWLPFARPTNLTDEFEFPIGT YLNYECRPGYSGRPFSIICLKNSVWTGAKDRCRRKSCRNPPDPVNGMVHVI KGIQFGSQIKYSCTKGYRLIGSSSATCIISGDTVIWDNETPICDRIPCGLP PTITNGDFISTNRENFHYGSVVTYRCNPGSGGRKVFELVGEPSIYCTSNDD QVGIWSGPAPQCIIPNKCTPPNVENGILVSDNRSLFSLNEVVEFRCPGFV MKGPRRVKCQALNKWEPELPSCSRVCQPPPDVLHAERTQRDKDNFSPGQEV FYSCEPGYDLRGAASMRCTPQGDWSPAAPTCEVKSCDDFMGQLLNGRVLFP VNLQLGAKVDFVCDEGFQLKGSSASYCVLAGMESLWNSSVPVCEQIFCPSP PVIPNGRHTGKPLEVFPFGKTVNYTCDPHPDRGTSFDLIGESTIRCTSDPQ GNGVW5SPAPRCGILGHCQAPDHFLFAKLKTQTNASDFPIGTSLKYECRPE YYGRPFSITCLDNLVWSSPKDVCKRKSCKTPPDPVNGMVHVITDIQVGSRI NYSCTTGHRLIGHSSAECILSGNAAHWSTKPPICQRIPCGLPPTIANGDFI STNRENFHYGSVVTYRCNPGSGGRKVFELVGEPSIYCTSNDDQVGIWSGPA PQCIIPNKENLYFQGHHHHHH |
| 119 | 3d8b heavy chain murine IgG1 (hole)-CR1 1-10 (pairs with #17) with TEV cleavage site | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLSCAI TDFFPEDITVEWQWNGQPAENYKNTQPIMDTDGSYFVVSKLNVQKSNWEAG NTFTCSVLHEGLHNHHTEKSLSHSPGGGGSGGGGSQCNAPEWLPFARPTN LTDEFEFPIGTYLNYECRPGYSGRPFSIICLKNSVWTGAKDRCRRKSCRNP PDPVNGMVHVIKGIQFGSQIKYSCTKGYRLIGSSSATCIISGDTVIWDNET PICDRIPCGLPPTITNGDFISTNRENFKYGSVVTYRCNPGSGGRKVFELVG EPSIYCTSNDDQVGIWSGPAPQCIIPNKCTPPNVENGILVSDNRSLFSLNE VVEFRCPGFVMKGPRRVKCQALNKWEPELPSCSRVCQPPPDVLHAERTQR DKDNFSPGQEVFYSCEPGYDLRGAASMRCTPQGDWSPAAPTCEVKSCDDFK GQLLNGRVLFPVNLQLGAKVDFVCDEGFQLKGSSASYCVLAGMESLWNSSV PVCEQIFCPSPPVIPNGRHTGKPLEVFPFGKTVNYTCDPHPDRGTSFDLIG ESTIRCTSDPQGNGWvSSPAPRCGILGHCQAPDHFLFAKLKTQTNASDFPI GTSLKYECRPEYYGRPFSITCLDNLVWSSPKDVCKRKSCKTPPDPVNGMVH VTTDIQVGSRINYSCTTGHRLIGHSSAECILSGNAAKWSTKPPICQRIPCG LPPTIANGDFISTNREHFHYGSVVTYRCNPGSGGRKVFELVGEPSIYCTSN DDQVGIWSGPAPQCIIPNKENLYFQGHHHHHH |
| 120 | 3d8b heavy chain murine IgG1-CR1 1-10 with TEV cleavage site | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCKI TDFFPEDITVEWQWNGQPAENYKNTQPIMDTDGSYFVYSKLNVQKSNWEAG NTFTCSVLHEGLKNHHTEKSLSHSPGGGGSGGGGSQCNAPEWLPFARPTN LTDEFEFPIGTYLNYECRPGYSGRPFSIICLKNSVWTGAKDRCRRKSCRNP PDPVNGMVHVIKGIQFGSQIKYSCTKGYRLIGSSSATCIISGDTVIWDNET PICDRIPCGLPPTITNGDFISTNRENFHYGSVVTYRCNPGSGGRKVFELVG EPSIYCTSNDDQVGIWSGPAPQCIIPNKCTPPNVENGILVSDNRSLFSLNE VVEFRCPGFVMKGPRRVKCQALNKWEPELPSCSRVCQPPPDVLKAERTQR DKDNFSPGQEVFYSCEPGYDLRGAASMRCTPQGDWSPAAPTCEVKSCDDFM GQLLNGRVLFPVNLQLGAKVDFVCDEGFQLKGSSASYCVLAGMESLWNSSV PVCEQIFCPSPPVIPNGRHTGKPLEVFPFGKTVNYTCDPHPDRGTSFDLIG ESTIRCTSDPQGNGVWSSPAPRCGILGKCQAPDHFLFAKLKTQTNASDFPI GTSLKYECRPEYYGRPFSITCLDNLVWSSPKDVCKRKSCKTPPDPVNGMVH VITDIQVGSRINYSCTTGHRLIGHSSAECILSGNAAHWSTKPPICQRIPCG LPPTIANGDFISTNRENFHYGSVVTYRCNPGSGGRKVFELVGEPSIYCTSN DDQVGIWSGPAPQCIIPNKENLYFQGHHKHHH |

TABLE 36-continued

SEQUENCE TABLE

| SEQ ID NO: | DESCRIPTION | SEQUENCE |
|---|---|---|
| 121 | 3d8b heavy chain murine IgG1 (hole)-fH 1-5 (pairs with 3d8b heavy chain murine IgG1 (knob)) with TEV cleavage site | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFKSTFRSVSELPIMHQDWLNGKE FKCRVNSAAFPAPIEKTISKTKGRPKAPQVYTIPPPKEQKAKDKVSLSCAI TDFFPEDITVEWQWNGQPAENYKNTQPIMDTDGSYFVVSKLNVQKSNWEAG NTFTCSVLHEGLHNHHTEKSLSHSPGGGGSGGGGSEDCNELPPRRNTEIL TGSWSDQTYPEGTQAIYKCRPGYRSLGNVIMVCRKGEWVALNPLRKCQKRP CGKPGDTPFGTFTLTGGNVFEYGVKAVYTCNEGYQLLGEINYRECDTDGWT NDIPICEVVKCLPVTAPENGKIVSSAMEPDREYHFGQAVRFVCNSGYKIEG DEEMKCSDDGFWSKEKPKCVEISCKSPDVINGSPISQKIIYKENERFQYKC NMGYEYSERGDAVCTESGWRPLPSCEEKSCDNPYIPNGDYSPLRIKHRTGD EITYQCRNGFYPATRGNTAKCTSTGWIPAPRCTLK<u>ENLYFQ</u>GHHHHHH |
| 122 | 3d8b heavy chain murine IgG1-fH 1-5 with cleavage site | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRTQSAAFPAPIEKTISKTKGRPKAPQVYTIPPPKEQMAKDKVSLTCMI TDFFPEDITVEWQWNGQPAENYKNTQPIMDTDGSYFVYSKLNVQKSNWEAG NTFTCSVLHEGLHNHHTEKSLSHSPGGGGSGGGGSEDCNELPPRRNTEIL TGSWSDQTYPEGTQAIYKCRPGYRSLGNVIMVCRKGEWVALNPLRKCQKRP CGHPGDTPFGTFTLTGGNVFEYGVKAVYTCNEGYQLLGEINYRECDTDGWT NDIPICEVVKCLPVTAPENGKIVSSAMEPDREYHFGQAVRFVCNSGYKIEG DEEMHCSDDGFWSKEKPKCVEISCKSPDVINGSPISQKIIYKENERFQYKC NMGYEYSERGDAVCTESGWRPLPSCEEKSCDNPYIPNGDYSPLRIKHRTGD EITYQCRNGFYPATRGNTAKCTSTGWIPAPRCTLK<u>ENLYFQ</u>GHHHHHH |
| 123 | CR1 1-10-3d8b heavy chain murine IgG1-His with TEV cleavage site | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEVVEFRCQPGFRVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPHPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSEVQLQQS GPVLVKPGASVKMSCKASGYTFTNYYINWVKQSHGKSLEWIGVINPYNGGT SYNQKFKGKATLTVDKSSSTAYMELNSLTSEDSAVYFCSSPYWGQGTSVTV SSAKTTPPSVYPLAPGSAAQTNSMVTLGCLVKGYFPEPVTVTWNSGSLSSG VKTFPAVLQSDLYTLSSSVTVPSSTWPSETVTCNVAHPASSTKVDKKIVPR DCGCKPCICTVPEVSSVFIFPPKPKDVLTITLTPKVTCVVVDISKDDPEVQ FSWFVDDVEVHTAQTQPREEQFNSTFRSVSELPIMHQDWLNGKEFKCRVNS AAFPAPIEKTISKTKGRPKAPQVYTIPPPKEQMAKDKVSLTCMITDFFPED ITVEWQWNGQPAENYKNTQPIMDTDGSYFVYSKLNVQKSNWEAGNTFTCSV LHEGLHKHHTEKSLSHSPG<u>ENLYFQ</u>GHHHHHH |
| 124 | CR1 1-10-3d8b kappa light chain-His with TEV cleavage site | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPKPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSDVVMTQT PLTLSVTIGQPASISCKSSQSLLDSDGKTYLNWLLQRPGQSPKRLIYLVSK LDSGVPDRFTGSGSGTDFTLKISRVEAEDLGVYYCWQGTHPPRTFGGGTKL EIRRADAAPTVSIFPPSSEQLTSGGASVVCFLNNFYPKDINVKWKIDGSER QNGVLNSWTDQDSKDSTYSMSSTLTLTKDEYERHNSYTCEATHKTSTSPIV KSFNRKEC<u>ENLYFQ</u>GHHHHHH |

TABLE 36-continued

SEQUENCE TABLE

| SEQ ID NO: | DESCRIPTION | SEQUENCE |
| --- | --- | --- |
| 125 | 3d29 heavy chain murine IgG1-CR1 1-10 | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAKPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMKQDWLNG KEFKCRVNSAAFPAPIEKTISKTKGRPKAPQVYTIPPPKEQMAKDKVSLTC MITDFFPEDITVEWQWNGQPAENYKNTQPIMDTDGSYFVYSKLNVQKSNWE AGNTFTCSVLHEGLHNHHTEKSLSHSPGGGGSGGGGSQCNAPEWLPFARP TNLTDEFEFPIGTYLNYECRPGYSGRPFSIICLKNSVWTGAKDRCRRKSCR NPPDPVNGMVHVIKGIQFGSQIKYSCTKGYRLIGSSSATCIISGDTVIWDN ETPICDRIPCGLPPTITNGDFISTNRENFHYGSVVTYRCNPGSGGRKVFEL VGEPSIYCTSNDDQVGIWSGPAPQCIIPNKCTPPNVENGILVSDNRSLFSL NEVVEFRCQPGFVMKGPRRVKCQALNKWEPELPSCSRVCQPPPDVLHAERT QRDKDNFSPGQEVFYSCEPGYDLRGAASMRCTPQGDWSPAAPTCEVKSCDD FMGQLLNGRVLFPVNLQLGAKVDFVCDEGFQLKGSSASYCVLAGMESLWNS SVPVCEQIFCPSPPVIPNGRHTGKPLEVFPFGKTVNYTCDPHPDRGTSFDL IGESTIRCTSDPQGNGVWSSPAPRCGILGHCQAPDHFLFAKLKTQTNASDF PIGTSLKYECRPEYYGRPFSITCLDNLVWSSPKDVCKRKSCKTPPDPVNGM VHVITDIQVGSRINYSCTTGHRLIGHSSAECILSGNAAHWSTKPPICQRIP CGLPPTIANGDFISTNRENFKYGSVVTYRCNPGSGGRKVFELVGEPSIYCT SNDDQVGIWSGPAPQCIIPNK |
| 126 | 3d29 heavy chain murine IgG1-CR1 1-10 His tag | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAHPASST KVDKKIVPRDCGCKPCICTVPEVSSVFIFPPKPKDVLTITLTPKVTCVVVD ISKDDPEVQFSWFVDDVEVKTAQTQPREEQFNSTFRSVSELPIMHQDWLNG KEFKCRVNSAAFPAPIEKTISKTKGRPKAPQVYTIPPPKEQMAKDKVSLTC MITDFFPEDITVEWQWNGQPAENYKNTQPIMDTDGSYFVYSKLNVQKSNWE AGNTFTCSVLHEGLHNHHTEKSLSHSPGGGGSGGGGSQCNAPEWLPFARP TNLTDEFEFPIGTYLNYECRPGYSGRPFSIICLKNSVWTGAKDRCRRKSCR NPPDPVNCKVHVIKGIQFGSQIKYSCTKGYRLIGSSSATCIISGDTVIWDN ETPICDRIPCGLPPTITNGDFISTNRENFHYGSVVTYRCNPGSGGRKVFEL VGEPSIYCTSNDDQVGIWSGPAPQCIIPNKCTPPNVENGILVSDNRSLFSL NEVVEFRCQPGFVMKGPRRVKCQALNKWEPELPSCSRVCQPPPDVLHAERT QRDKDNFSPGQEVFYSCEPGYDLRGAASMRCTPQGDWSPAAPTCEVKSCDD FMGQLLNGRVLFPVNLQLGAKVDFVCDEGFQLKGSSASYCVLAGMESLWNS SVPVCEQIFCPSPPVIPNGRHTGKPLEVFPFGKTVNYTCDPHPDRGTSFDL IGESTIRCTSDPQGNGVWSSPAPRCGILGHCQAPDHFLFAKLKTQTNASDF PIGTSLKYECRPEYYGRPFSITCLDNLVWSSPKDVCKRKSCKTPPDPVNGK VHVITDIQVGSRINYSCTTGHRLIGHSSAECILSGNAAHWSTKPPICQRIP CGLPPTIANGDFISTNRENFKYGSVVTYRCNPGSGGRKVFELVGEPSIYCT SNDDQVGIWSGPAPQCIIPNKHHHHHH |
| 127 | 3d29 heavy chain murine IgG1 (knob)-CR1 1-10 His tag | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLTVSSAKTTPPSVYPLAPGSAAQTNSMVTLGCLVKGYFPEPVTVT WNSGSLSSGVHTFPAVLQSDLYTLSSSVTVPSSTWPSETVTCNVAKPASST KVDKKIVPRDCGCKPCICTVPEVSSVFIFPPKPKDVLTITLTPKVTCVVVD ISKDDPEVQFSWFVDDVEVHTAQTQPREEQFNSTFRSVSELPIMKQDWLNG KEFKCRVNSAAFPAPIEKTISKTKGRPKAPQVYTIPPPKEQMAKDKVSLWC MITDFFPEDITVEWQWNGQPAENYKNTQPIMDTDGSYFVYSKLNVQKSNWE AGNTFTCSVLHEGLHNHHTEKSLSHSPGGGGSGGGGSQCNAPEWLPFARP TNLTDEFEFPIGTYLNYECRPGYSGRPFSIICLKNSVWTGAKDRCRRKSCR NPPDPVNGMVHVIKGIQFGSQIKYSCTKGYRLIGSSSATCIISGDTVIWDN ETPICDRIPCGLPPTITNGDFISTMRENFHYGSVVTYRCNPGSGGRKVFEL VGEPSIYCTSNDDQVGIWSGPAPQCIIPNKCTPPNVENGILVSDNRSLFSL NEVVEFRCQPGFVMKGPRRVKCQALNKWEPELPSCSRVCQPPPDVLHAERT QRDKDNFSPGQEVFYSCEPGYDLRGAASMRCTPQGDWSPAAPTCEVKSCDD FMGQLLNGRVLFPVNLQLGAKVDFVCDEGFQLKGSSASYCVLAGMESLWNS SVPVCEQIFCPSPPVIPNGRKTGKPLEVFPFGKTVNYTCDPHPDRGTSFDL IGESTIRCTSDPQGNGVWSSPAPRCGILGHCQAPDHFLFAKLKTQTNASDF PIGTSLKYECRPEYYGRPFSITCLDNLTOSSPKDVCKRKSCKTPPDPVNGM VKVITDIQVGSRINYSCTTGHRLIGHSSAECILSGNAAHWSTKPPICQRIP CGLPPTIANGDFISTNRENFHYGSVVTYRCNPGSGGRKVFELVGEPSIYCT SNDDQVGIWSGPAPQCIIPNKKHHHHH |

TABLE 36-continued

SEQUENCE TABLE

| SEQ ID NO: | DESCRIPTION | SEQUENCE |
|---|---|---|
| 128 | 3d8b kappa light chain-fH 1-5-His with TEV cleavage site | DVVMTQTPLTLSVTIGQPASISCKSSQSLLDSDGKTYLNWLLQRPGQSPKR LIYLVSKLDSGVPDRFTGSGSGTDFTLKISRVEAEDLGVYYCWQGTHFPRT FGGGTKLEIRRADAAPTVSIFPPSSEQLTSGGASVVCFLNNFYPKDINVKW KIDGSERQNGVLNSWTDQDSKDSTYSMSSTLTLTKDEYERHNSYTCEATHK TSTSPIVKSFNRNECGGGGSGGGGSEDCNELPPRRNTEILTGSWSDQTYPE GTQAIYKCRPGYRSLGNVIMVCRKGEWVALNPLRKCQKRPCGHPGDTPFGT FTLTGGNVFEYGVKAVYTCNEGYQLLGEIKYRECDTDGWTNDIPICEVVKC LPVTAPENGKIVSSAMEPDREYHFGQAVRFVCNSGYKIEGDEEMHCSDDGF WSKEKPKCVEISCKSPDVINGSPISQKIIYKENERFQYKCNMGYEYSERGD AVCTESGWRPLPSCEEKSCDNPYIPNGDYSPLRIKHRTGDEITYQCRNGFY PATRGNTAKCTSTGWIPAPRCTLK<u>ENLYFQ</u>GHHHHHH |
| 129 | fH 1-5-3d8b kappa light chain-His with TEV cleavage site | EDCNELPPRRNTEILTGSWSDQTYPEGTQAIYKCRPGYRSLGNVIMVCRKG EWVALNPLRKCQKRPCGHPGDTPFGTFTLTGGNVFEYGVKAVYTCNEGYQL LGEINYRECDTDGWTNDIPICEVVKCLPVTAPENGKIVSSAKEPDREYHFG QAVRFVCNSGYKIEGDEEMHCSDDGFWSKEKPKCVEISCKSPDVINGSPIS QKIIYKENERFQYKCNKGYEYSERGDAVCTESGWRPLPSCEEKSCDNPYIP NGDYSPLRIKHRTGDEITYQCRNGFYPATRGNTAKCTSTGWIPAPRCTLKG GGGSGGGGSDVVMTQTPLTLSVTIGQPASISCKSSQSLLDSDGKTYLNWLL QRPGQSPKRLIYLVSKLDSGVPDRFTGSGSGTDFTLKISRVEAEDLGVYYC WQGTHFPRTFGGGTKLEIRRADAAPTVSIFPPSSEQLTSGGASVVCFLNNF YPKDINVKWKIDGSERQNGVLNSWTDQDSKDSTYSMSSTLTLTKDEYERHN SYTCEATHKTSTSPIVKSFNRNEC<u>ENLYFQ</u>GHHHHHH |
| 130 | CR1 1-10-murine IgG1 Fc (knob) | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFISTNREKFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPFGKTVNYT CDPHPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKGGGGSGGGGSGCKPCIC TVPEVSSVFTFPPKPKDVLTITLTPKVTCVVVDISKDDPEVQFSWFVDDVE VKTAQTQPREEQFNSTFRSVSELPIMHQDWLNGKEFKCRVNSAAFPAPIEK TISKTKGRPKAPQVYTIPPPKEQMAKDKVSLWCMITDFFPEDITVEWQWNG QPAENYKNTQPIMDTDGSYFVYSKLNVQKSNWEAGNTFTCSVLHEGLHNHH TEKSLSHSPG |
| 131 | fH 1-5-murine IgG1 Fc (knob) | EDCNELPPRRNTEILTGSWSDQTYPEGTQAIYKCRPGYRSLGNVIMVCRKG EWVALNPLRKCQKRPCGHPGDTPFGTFTLTGGNVFEYGVKAVYTCNEGYQL LGEINYRECDTDGWTNDIPICEVVKCLPVTAPENGKIVSSAKEPDREYHFG QAVRFVCNSGYKIEGDEEMHCSDDGFWSKEKPKCVEISCKSPDVINGSPIS QKIIYKENERFQYKCNMGYEYSERGDAVCTESGWRPLPSCEEKSCDNPYIP NGDYSPLRIKHRTGDEITYQCRNGFYPATRGNTAKCTSTGWIPAPRCTLKG GGGSGGGGSGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLWCMI TDFFPEDITVEWQWNGQPAENYKNTQPIMDTDGSYFVYSKLNVQKSNWEAG NTFTCSVLHEGLHNHHTEKSLSHSPG |
| 132 | 3d8b Fab heavy chain murine IgG1-CR1 1-17 wit TEV cleavage site | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGGGGSGGGGSQCNAPEWLPFARPTNLTDEFEFPIGTYLNYE CRPGYSGRPFSIICLKNSVWTGAKDRCRRKSCRNPPDPVNGMVHVIKGIQF GSQIKYSCTKGYRLIGSSSATCIISGDTVIWDNETPICDRIPCGLPPTITN GDFISTNRENFHYGSVVTYRCNPGSGGRKVFELVGEPSIYCTSNDDQVGIW SGPAPQCIIPNKCTPPNVENGILVSDNRSLFSLNEVVEFRCQPGFVMKGPR RVKCQALNKWEPELPSCSRVCQPPPDVLHAERTQRDKDNFSPGQEVFYSCE PGYDLRGAASMRCTPQGDWSPAAPTCEVKSCDDFMGQLLNGRVLFPVNLQL GAKVDFVCDEGFQLKGSSASYCVLAGMESLWNSSVPVCEQIFCPSPPVIPN GRHTGKPLEVFPFGKTVNYTCDPHPDRGTSFDLIGESTIRCTSDPQGNGVW SSPAPRCGILGRCQAPDHFLFAKLKTQTNASDFPIGTSLKYECRPEYYGRP FSITCLDNLVWSSPKDVCKRKSCKTPPDPVNGMVHVITDIQVGSRINYSCT TGHRLIGHSSAECILSGNAAHWSTKPPICQRIPCGLPPTIANGDFISTNRE NFHYGSVVTYRCNPGSGGRKVFELVGEPSIYCTSNDDQVGIWSGPAPQCII PNKCTPPNVENGILVSDMRSLFSLNEVVEFRCQPGFVMKGPRRVKCQALMK WEPELPSCSRVCQPPPDVLHAERTQRDKDNFSPGQEVFYSCEPGYDLRGAA SMRCTPQGDWSPAAPTCEVKSCDDFMGQLLNGRVLFPVNLQLGAKVDFVCD EGFQLKGSSASYCVLAGMESLWNSSVPVCEQIFCPSPPVIPNGRHTGKPLE |

TABLE 36-continued

SEQUENCE TABLE

| SEQ ID NO: | DESCRIPTION | SEQUENCE |
|---|---|---|
| | | VFPFGKAVNYTCDPHPDRGTSFDLIGESTIRCTSDPQGNGVWSSPAPRCGI<br>LGKCQAPDHFLFAKLKTQTNASDFPIGTSLKYECRPEYYGRPFSITCLDNL<br>VWSSPKDVGKRKSCKTPPDPVNGMVHVITDIQVGSRINYSCTTGHRLIGHS<br>SAECILSGNTARWSTKPPICQRIPCGLPPTIANGDFISTNRENFHYGSVVT<br>YRCNLGSRGRKVFELVGEPSIYCTSNDDQVGIWSGPAPQCIIPNK<u>ENLYFQ</u><br><u>G</u>HHKKHH |
| 133 | 3d8b<br>heavy chain<br>murine<br>IgG1<br>(hole)-<br>CR1 1-17<br>(pairs 3d8b<br>heavy chain<br>murine IgG1<br>(knob))<br>with TEV<br>cleavage<br>site | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTKGRPKAPQVYTIPPPKEQMAKDKVSLSCAI<br>TDFFPEDITVEWQWNGQPAENYKNTQPIMDTDGSYFVVSKLNVQKSNWEAG<br>NTFTCSVLHEGLHNHHTEKSLSHSPGGGGSGGGGSQCNAPEWLPFARPTN<br>LTDEFEFPIGTYLNYECRPGYSGRPFSIICLKNSVWTGAKDRCRRKSCRNP<br>PDPVNGMVHVIKGIQFGSQIKYSCTKGYRLIGSSSATCIISGDTVIWDNET<br>PICDRIPCGLPPTITNGDFISTNRENFHYGSVVTYRCNPGSSGRKVFELVG<br>EPSIYCTSNDDQVGIWSGPAPQCIIPNKCTPPNVENGILVSDNRSLFSLNE<br>VVEFRCQPGFVMKGPRRVKCQALNKWEPELPSCSRVCQPPPDVLHAERTQR<br>DKDNFSPGQEVFYSCEPGYDLRGAASMRCTPQGDWSPAAPTCEVKSCDDFM<br>GQLLNGRVLFPVNLQLGAKVDFVCDEGFQLKGSSASYCVLAGMESLWNSSV<br>PVCEQIFCPSPPVIPNGRHTGKPLEVFPFGKTVNYTCDPHPDRGTSFDLIG<br>ESTIRCTSDPQGNGVWSSPAPRCGILGHCQAPDHFLFAKLKTQTNASDFPI<br>GTSLKYECRPEYYGRPFSITCLDNLVWSSPKDVCKRKSCKTPPDPVNGMVH<br>VITDIQVGSRINYSCTTGHRLIGHSSAECILSGNAAHWSTKPPICQRIPCG<br>LPPTIANGDFISTNRENFHYGSVVTYRCNPGSSGRKVFELVGEPSIYCTSN<br>DDQVGIWSGPAPQCIIPNKCTPPNVENGILVSDNRSLFSLNEVVEFRCQPG<br>FVMKGPRRVKCQALNKWEPELPSCSRVCQPPPDVLHAERTQRDKDNFSPGQ<br>EVFYSCEPGYDLRGAASMRCTPQGDWSPAAPTCEVKSCDDFMGQLLNGRVL<br>FPVNLQLGAKVDFVCDEGFQLKGSSASYCVLAGKESLWNSSVPVCEQIFCP<br>SPPVIPNGRHTGKPLEVFPFGKAVNYTCDPHPDRGTSFDLIGESTIRCTSD<br>PQGNGVWSSPAPRCGILGHCQAPDHFLFAKLKTQTNASDFPIGTSLKYECR<br>PEYYGRPFSITCLDNLVWSSPKDVCKRKSCKTPPDPVNGMVHVITDIQVGS<br>RINYSCTTGRRLIGHSSAECILSGNTAHWSTKPPICQRIPCGLPPTIAKGD<br>FISTNRENFHYGSVVTYRCNLGSRGRKVFELVGEPSIYCTSNDDQVGIWSG<br>PAPQCIIPNK<u>ENLYFQ</u>GHHHHRH |
| 134 | 3d8b<br>heavy chain<br>murine<br>IgG1-<br>CR1 1-17<br>with TEV<br>cleavage<br>site | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTKGRPKAPQVYTIPPPKEQMAKDKVSLSCMI<br>TDFFPEDITVEWQWNGQPAENYKNTQPIMDTDGSYFVYSKLNVQKSNWEAG<br>NTFTCSVLHEGLHNHHTEKSLSHSPGGGGSGGGGSQCNAPEWLPFARPTN<br>LTDEFEFPIGTYLNYECRPGYSGRPFSIICLKNSVWTGAKDRCRRKSCRNP<br>PDPVNGMVHVIKGIQFGSQIKYSCTKGYRLIGSSSATCIISGDTVIWDNET<br>PICDRIPCGLPPTITNGDFISTNRENFHYGSVVTYRCNPGSSGRKVFELVG<br>EPSIYCTSNDDQVGIWSGPAPQCIIPNKCTPPNVENGILVSDNRSLFSLNE<br>VVEFRCQPGFVMKGPRRVKCQALNKWEPELPSCSRVCQPPPDVLHAERTQR<br>DKDNFSPGQEVFYSCEPGYDLRGAASMRCTPQGDWSPAAPTCEVKSCDDFM<br>GQLLNGRVLFPVNLQLGAKVDFVCDEGFQLKGSSASYCVLAGMESLWNSSV<br>PVCEQIFCPSFPVIPNGRHTGKPLEVFPFGKTVNYTCDPHPDRGTSFDLIG<br>ESTIRCTSDPQGNGVWSSPAPRCGILGKCQAPDHFLFAKLKTQTNASDFPI<br>GTSLKYECRPEYYGRPFSITCLDNLVWSSPKDVCKRKSCKTPPDPVNGMVH<br>VITDIQVGSRINYSCTTGHRLIGHSSAECILSGNAAHWSTKPPICQRIPCG<br>LPPTIANGDFISTNRENFHYGSVVTYRCNPGSSGRKVFELVGEPSIYCTSN<br>DDQVGIWSGPAPQCIIPNKCTPPNVENGILVSDNRSLFSLNEVVEFRCQPG<br>FVMKGPRRVKCQALNKWEPELPSCSRVCQPPPDVLHAERTQRDKDNFSPGQ<br>EVFYSCEPGYDLRGAASMRCTPQGDWSPAAPTCEVKSCDDFMGQLLNGRVL<br>FPVNLQLGAKVDFVCDEGFQLKGSSASYCVLAGMESLWNSSVPVCEQIFCP<br>SPPVIPNGRHTGKPLEVFPFGKAVNYTCDPHPDRGTSFDLIGESTIRCTSD<br>PQGNGVWSSPAPRCGILGHCQAPDHFLFAKLKTQTNASDFPIGTSLKYECR<br>PEYYGRPFSITCLDNLVWSSPKDVCKRKSCKTPPDPVNGMVHVITDIQVGS<br>RINYSCTTGHRLIGHSSAECILSGMTAKWSTKPPICQRIPCGLPPTIANGD<br>FISTNRENFHYGSVVTYRCNLGSRGRKVFELVGEPSIYCTSNDDQVGIWSG<br>PAPQCIIPNK<u>ENLYFQ</u>GHHHHHH |
| 135 | 3d8b<br>kappa<br>light<br>chain-<br>CR1 1-17 | DVVMTQTPLTLSVTIGQPASISCKSSQSLLDSDGKTYLNWLLQRPGQSPKR<br>LIYLVSKLDSGVPDRFTGSGSGTDFTLKISRVEAEDLGVYYCWQGTHFPRT<br>FGGGTKLEIRRADAAPTVSIFPPSSEQLTSGGASVVCFLNNFYPKDINVKW<br>KIDGSERQNGVLNSWTDQDSKDSTYSMSSTLTLTKDEYERHNSYTCEATHK<br>TSTSPIVKSFNRNECGGGGSGGGGSQCNAPEWLPFARPTNLTDEFEFPIGT |

TABLE 36-continued

SEQUENCE TABLE

| SEQ ID NO: | DESCRIPTION | SEQUENCE |
|---|---|---|
| | with TEV cleavage site | YLNYECRPGYSGRPFSIICLKNSVWTGAKDRCRRKSCRNPPDPVNGMVHVI KGIQFGSQIKYSCTKGYRLIGSSSATCIISGDTVIWDNETPICDRIPCGLP PTITNGDFISTNRENFHYGSVVTYRCNPGSGGRKVFELVGEPSIYCTSNDD QVGIWSGPAPQCIIPNKCTPPNVENGILVSDNRSLFSLNEVVEFRCQPGFV KKGPRRVKCQALNKWEPELPSCSRVCQPPPDVLHAERTQRDKDNFSPGQEV FYSCEPGYDLRGAASMRCTPQGDWSPAAPTCEVKSCDDFMGQLLNGRVLFP VNLQLGAKVDFVCDEGFQLKGSSASYCVLAGMESLWNSSVPVCEQIFCPSP PVIPNGRHTGKPLEVFPPFGKTVNYTCDPRPDRGTSFDLIGESTIRCTSDPQ GNGVWSSPAPRCGILGHCQAPDHFLFAKLKTQTNASDFPIGTSLKYECRPE YYGRPFSITCLDNLVWSSPKDVCKRKSCKTPPDPVNGMVHVITDIQVGSRI NYSCTTGHRLIGHSSAECILSGNAAHWSTKPPICQRIPCGLPPTIANGDFI STNRENFHYGSVVTYRCMPGSGGRKVFELVGEPSIYCTSNDDQVGIWSGPA PQCIIPNKCTPPNVENGILVSDNRSLFSLNEVVEFRCQPGFVKKGPRRVKC QALNKWEPELPSCSRVCQPPPDVLHAERTQRDKDNFSPGQEVFYSCEPGYD LRGAASMRCTPQGDWSPAAPTCEVKSCDDFMGQLLNGRVLFPVNLQLGAKV DFVCDEGFQLKGSSASYCVLAGMESLWNSSVPVCEQIFCPSPPVTPNGRHT GKPLEVFPPFGKAVNYTCDPKPDRGTSFDLIGESTIRCTSDPQGNGVWSSPA PRCGILGHCQAPDHFLFAKLKTQTMASDFPIGTSLKYECRPEYYGRPFSIT CLDNLVWSSPKDVCKRKSCKTPPDPVNGMVHVITDIQVGSRINYSCTTGHR LIGHSSAECILSGNTAHWSTKPPICQRIPCGLPPTIANGDFISTNRENFHY GSVVTYRCNLGSRGRKVFELVGEPSIYCTSNDDQVGIWSGPAPQCIIPNKE NLYFQGHHHHHH |
| 136 | CR1 1-17-3d8b heavy chain murine IgG1 with TEV cleavage site | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVTWDNETPICDRIPCGLPPTITNGDFISTNRENFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASKRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPPFGKTVNYT CDPHPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKCTPPNVENGILVSDNRS LFSLNEVVEFRCQPGFVMKGPRRVKCQALNKWEPELPSCSRVCQPPPDVLH AERTQRDKDNFSPGQEVFYSCEPGYDLRGAASMRCTPQGDWSPAAPTCEVK SCDDFMGQLLNGRVLFPVNLQLGAKVDFVCDEGFQLKGSSASYCVLAGMES LWNSSVPVCEQIFCPSPPFVIPNGRHTGKPLEVFPPFGKAVNYTCDPKPDRGT SFDLIGESTIRCTSDPQGNGVWSSPAPRCGILGHCQAPDHFLFAKLKTQTN ASDFPIGTSLKYECRPEYYGRPFSITCLDNLVWSSPKDVCKRKSCKTPPD PVNGMVHVITDIQVGSRINYSCTTGHRLIGHSSAECILSGNTAHWSTKPPIC QRIPGGLPPTIANGDFISTNRENFHYGSVVTYRCNLGSRGRKVFELVGEPS IYCTSNDDQVGIWSGPAPQCIIPNKGGGGSGGGGSEVQLQQSGPVLVKPGA SVKMSCKASGYTFTNYYINWVKQSHGKSLEWIGVINPYNGGTSYNQKFKGK ATLTVDKSSSTAYMELNSLTSEDSAVYFCSSPYWGQGTSVTVSSAKTTPPS VYPLAPGSAAQTNSMVTLGCLVKGYFPEPVTVTWNSGSLSSGVKTFPAVLQ SDLYTLSSSVTVPSSTWPSETVTCNVAHPASSTKVDKKIVPRDCGCKPCIC TVPEVSSVFIFPPKPKDVLTITLTPKVTCVVVDISKDDPEVQFSWFVDDVE VHTAQTQPREEQFNSTFRSVSELPIMHQDWLNGKEFKCRVNSAAFPAPIEK TISKTKGRPKAPQVYTIPPPKEQMAKDKVSLTCMITDFFPEDITVEWQWNG QPAENYKNTQPIMDTGSYFVYSKLNVQKSNWEAGNTFTCSVLHEGLHNHH TEKSLSHSPGENLYFQGHHHHHH |
| 137 | CR1 1-17-3d8b kappa light chain-His with TEV cleavage site | QCNAPEWLPFARPTNLTDEFEFPIGTYLNYECRPGYSGRPFSIICLKNSVW TGAKDRCRRKSCRNPPDPVNGMVHVIKGIQFGSQIKYSCTKGYRLIGSSSA TCIISGDTVIWDNETPICDRIPCGLPPTITNGDFSTNRENFHYGSVVTYR CNPGSGGRKVFELVGEPSIYCTSNDDQVGIWSGPAPQCIIPNKCTPPNVEN GILVSDNRSLFSLNEVVEFRCQPGFVMKGPRRVKCQALNKWEPELPSCSRV CQPPPDVLHAERTQRDKDNFSPGQEVFYSCEPGYDLRGAASMRCTPQGDWS PAAPTCEVKSCDDFMGQLLNGRVLFPVNLQLGAKVDFVCDEGFQLKGSSAS YCVLAGMESLWNSSVPVCEQIFCPSPPVIPNGRHTGKPLEVFPPFGKTVNYT CDPKPDRGTSFDLIGESTIRCTSDPQGNGVWSSPAPRCGILGHCQAPDHFL FAKLKTQTNASDFPIGTSLKYECRPEYYGRPFSITCLDNLVWSSPKDVCKR KSCKTPPDPVNGMVHVITDIQVGSRINYSCTTGHRLIGHSSAECILSGNAA HWSTKPPICQRIPCGLPPTIANGDFISTNRENFHYGSVVTYRCNPGSGGRK VFELVGEPSIYCTSNDDQVGIWSGPAPQCIIPNKCTPPNVENGILVSDNRS LFSLNEVVEFRCQPGFVMKGPRRVKCQALNKWEPELPSCSRVCQPPPDVLH AERTQRDKDNFSPGQEVFYSCEPGYDLRGAASKRCTPQGDWSPAAPTCEVK SCDDFMGQLLNGRVLFPVNLQLGAKVDFVCDEGFQLKGSSASYCVLAGMES LWNSSVPVCEQIFCPSPPVIPNGRHTGKPLEVFPFGKAVNYTCDPHPDRGT SFDLIGESTIEQTSDPQGNGVWSSPAPRCGILGHCQAPDHFLFAKLKTQTN ASDFPIGTSLKYECRPEYYGRPFSITCLDNLVWSSPKDVCKRKSCKTPPDP VNGMVHVITDIQVGSRINYSCTTGHRLIGHSSAECILSGNTAHWSTKPPIC QRIPCGLPPTIANGDFISTNRENFHYGSVVTYRCNLGSRGRKVFELVGEPS |

TABLE 36-continued

SEQUENCE TABLE

| SEQ ID NO: | DESCRIPTION | SEQUENCE |
|---|---|---|
| | | IYCTSNDDQVGIWSGPAPQCIIPNKGGGGSGGGGSDVVMTQTPLTLSVTIG<br>QPASISCKSSQSLLDSDGKTYLNWLLQRPGQSPKRLIYLVSKLDSGVPDRF<br>TGSGSGTDFTLKISRVEAEDLGVYYCWQGTHFPRTFGGGTKLEIRRADAAP<br>TVSIFPPSSEQLTSGGASVVCFLNNFYPKDINVKWKIDGSERQNGVLNSWT<br>DQDSKDSTYSMSSTLTLTKDEYERHNSYTCEATHKTSTSPIVKSFNRNECE<br>NLYFQGHHHHHH |
| 138 | Exemplary<br>linker | GGGGSGGGGS |
| 139 | Heavy<br>chain<br>VH-IgG1<br>with<br>T366S/M368A/<br>Y407V<br>hole Fc-<br>linker-<br>factor H | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIKHQDWLNGKE<br>FKCRVNSAAFPAPIEKTISKTKGRPKAPQVYTIPPPKEQMAKDKVSLSCAI<br>TDFFPEDITVEWQWNGQPAENYKNTQPIMDTDGSYFVVSKLNVQKSNWEAG<br>NTFTCSVLHEGLKNHHTEKSLSHSPGGGGSGGGGSEDCNELPPRRNTEIL<br>TGSWSDQTYPEGTQAIYKCRPGYRSLGNVIMVCRKGEWVALMPLRKCQKRP<br>CGHPGDTPFGTFTLTGGNVFEYGVKAVYTCNEGYQLLGEINYRECDTDGWT<br>NDIPICEVVKCLPVTAPENGKIVSSAMEPDREYHFGQAVRFVCNSGYKIEG<br>DEEMHCSDDGFWSKEKPKCVEISCKSPDVINGSPISQKIIYKENERFQYKC<br>NMGYEYSERGDAVCTESGWRPLPSCEEKSCDNPYIPNGDYSPLRIKHRTGD<br>EITYQCRNGFYPATRGNTAKCSTGWIPAPRCTLK |
| 140 | Heavy<br>Chain:<br>VH-IgG1<br>with<br>T336W<br>knob Fc-<br>linker-<br>CR1 (1-<br>10) | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTKGRPKAPQVYTIPPPKEQMAKDKVSLWCMI<br>TDFFPEDITVEWQWNGQPAENYKNTQPIMDTDGSYFVYSKLNVQKSNWEAG<br>NTFTCSVLHEGLKNHHTEKSLSHSPGGGGSGGGGSQCNAPEWLPFARPTN<br>LTDEFEFPIGTYLNYECRPGYSGRPFSIICLKNSVWTGAKDRCRRKSCRNP<br>PDPVNGMVHVIKGIQFGSQIKYSCTKGYRLIGSSSATCIISGDTVIWDNET<br>PICDRIPCGLPPTITNGDFISTNRENFHYGSVVTYRCNPGSSGGRKVFELVG<br>EPSIYCTSNDDQVGIWSGPAPQCIIPNKCTPPNVENGILVSDNRSLFSLNE<br>VVEFRCQPGFVMKGPRRVKCQALNKWEPELPSCSRVCQPPPDVLHAERTQR<br>DKDNFSPGQEVFYSCEPGYDLRGAASMRCTPQGDWSPAAPTCEVKSCDDFK<br>GQLLNGRVLFPVNLQLGAKVDFVCDEGFQLKGSSASYCVLAGMESLWNSSV<br>PVCEQIFCPSPPVIPNGRHTGKPLEVFPFGKTVNYTCDPHPDRGTSFDLIG<br>ESTIRCTSDPQGNGVWSSPAPRCGILGHCQAPDHFLFAKLKTQTNASDFPI<br>GTSLKYECRPEYYGRPFSITCLDNLVWSSPKDVCKRKSCKTPPDPVNGMVH<br>VITDIQVGSRINYSCTTGHRLIGHSSAECILSGNAAKWSTKPPICQRIPCG<br>LPPTIANGDFISTNRENFHYGSVVTYRCNPGSGGRKVFELVGEPSIYCTSN<br>DDQVGIWSGPAPQCIIPNK |
| 141 | Heavy<br>Chain:<br>VH-<br>muIgG1-<br>linker-<br>DAF (1-4) | EVQLQQSGPVLVKPGASVKMSCKASGYTFTNYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAHPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTKGRPKAPQVYTIPPPKEQMAKDKVSLTCMI<br>TDFFPEDITVEWQWNGQPAENYKKTQPIMDTDGSYFVYSKLNVQKSNWEAG<br>NTFTCSVLHEGLHNHHTEKSLSHSPGGGGSGGGGSDCGLPPDVPNAQPAL<br>EGRTSFPEDTVITYKCEESFVKIPGEKDSVICLKGSQWSDIEEFCNRSCEV<br>PTRLNSASLKQPYITQNYFPVGTVVEYECRPGYRREPSLSPKLTCLQNLKW<br>STAVEFCKKKSCPNPGEIRNGQIDVPGGILFGATISFSCNTGYKLFGSTSS<br>FCLISGSSVQWSDPLPECREIYCPAPPQIDNGIIQGERDHYGYRQSVTYAC<br>NKGFTKIGEHSIYCTVNNDEGEWSGPPPECRG |
| 142 | Heavy<br>Chain:<br>VH-<br>muIgG1-<br>linker-<br>CD59 | EVQLQQSGPVLVKPGASVKMSCKASGYTFTKYYINWVKQSHGKSLEWIGVI<br>NPYNGGTSYNQKFKGKATLTVDKSSSTAYMELNSLTSEDSAVYFCSSPYWG<br>QGTSVTVSSAKTTPPSVYPLAPGSAAQTNSMVTLGCLVKGYFPEPVTVTWN<br>SGSLSSGVHTFPAVLQSDLYTLSSSVTVPSSTWPSETVTCNVAKPASSTKV<br>DKKIVPRDCGCKPCICTVPEVSSVFIFPPKPKDVLTITLTPKVTCVVVDIS<br>KDDPEVQFSWFVDDVEVHTAQTQPREEQFNSTFRSVSELPIMHQDWLNGKE<br>FKCRVNSAAFPAPIEKTISKTKGRPKAPQVYTIPPPKEQMAKDKVSLTCMI<br>TDFFPEDITVEWQWNGQPAENYKKTQPIMDTDGSYFVYSKLNVQKSNWEAG<br>NTFTCSVLHEGLHNHHTEKSLSHSPGGGGSGGGGSLQCYNCPNPTADCKT<br>AVNCSSDFDACLITKAGLQVYNKCWKFEKCNFNDVTTRLRENELTYYCCKK<br>DLCNFNEQLEN |

TABLE 36-continued

SEQUENCE TABLE

| SEQ ID NO: | DESCRIPTION | SEQUENCE |
|---|---|---|
| 143 | Heavy Chain: VH-MuIgG1-linker-Map44 | EVQLQQSGPVLVKPGASVKMSCKASGYTFTNYYINWVKQSHGKSLEWIGVI MPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCMI TDFFPEDITVEWQWNGQPAENYKNTQPIMDTDGSYFVYSKLNVQKSNWEAG NTFTCSVLHEGLHNHHTEKSLSHSPGGGGGSGGGGSKTVELNNMFGQIQSP GYPDSYPSDSEVTWNITVPDGFRIKLYFMKFNLESSYLCEYDYVKVETEDQ VLATFCGRETTDTEQTPGQEVVLSPGSFMSITFRSDFSNEERFTGFDAHYM AVDVDECKEREDEELSCDHYCHNYIGGYYCSCRFGYILHTDNRTCRVECSD NLFTQRTGVITSPDFPNPYPKSSECLYTIELEEGFMVNLQFEDIFDIEDHP EVPCPYDYIKIKVGPKVLGPFCGEKAPEPISTQSKSVLILFHSDNSGENRG WRLSYRAAGNECPELQPPVHGKIEPSQAKYFFKDQVLVSCDTGYKVLKDNV EMDTFQIECLKDGTWSNKIPTCKKNEIDLESELKSEQVTE |
| 144 | Heavy Chain: VH-muIgG1-linker-MCP 1-4 | EVQLQQSGPVLVKPGASVKMSCKASGYTFTNYYINWVKQSHGKSLEWIGVI NPYNGGTSYNQKFKGKATLTVDKSSSTAYMELNSLTSEDSAVYFCSSPYWG QGTSVTVSSAKTTPPSVYPLAPGSAAQTNSMVTLGCLVKGYFPEPVTVTWN SGSLSSGVHTFPAVLQSDLYTLSSSVTVPSSTWPSETVTCNVAHPASSTKV DKKIVPRDCGCKPCICTVPEVSSVFIFPPKPKDVLTITLTPKVTCVVVDIS KDDPEVQFSWFVDDVEVHTAQTQPREEQFNSTFRSVSELPIMHQDWLNGKE FKCRVNSAAFPAPIEKTISKTKGRPKAPQVYTIPPPKEQMAKDKVSLTCMI TDFFPEDITVEWQWNGQPAENYKNTQPIMDTDGSYFVYSKLNVQKSNWEAG NTFTCSVLHEGLHNHHTEKSLSHSPGGGGGSGGGGSCEEPPTFEAMELIGK PKPYYEIGERVDYKCKKGYFYIPPLATHTICDRNETWLPVSDDACYRETCP YIRDPLNGQAVPANGTYEFGYQMHFICNEGYYLIGEEILYCELKGSVAIWS GKPPICEKVLCTPPPKIKNGKHTFSEVEVFEYLDAVTYSCDPAPGPDPFSL IGESTIYCGDNSVWSRAAPECKVVKCREPVVENGKQISGEGKKFYYKATVM FECDKGFYLDGSDTIVCDSNSTWDPPVPKCLK |
| 145 | Exemplary anti-C3d antibody, C8D3, heavy chain sequence | QAYLQQSGAELVRPGASVKMSCKASGYTFTSYYMHWVKQTPRQGLEWIGAI YPGNGDTSYNQKFKGKATLTVDKSSSTAYMQLSSLTSEDSAVYFCAKGFDY WGQGTTVTVSS |
| 146 | Exemplary anti-C3d antibody, C8D3, light chain sequence | DVVMTQTPLSLPVSLGDQASISCRSSQSLVYSNGNTYLHWYLQKPGQSPKL LIYKVSNRFSGVPDRFSGSGSGTDFTLKISRVEAEDLGVYFCSQSTHVPYT FGGGTKLEIKR |
| 147 | Exemplary anti-C3d antibody, C8D3, CDRH1 | GYTFTSYY |
| 148 | Exemplary anti-C3d antibody, C8D3, CDRH2 | IYPGNGDT |
| 149 | Exemplary anti-C3d antibody, C8D3, CDRH3 | AKGFDY |
| 150 | Exemplary anti-C3d antibody, C8D3, CDRL1 | QSLVYSNGNTY |

TABLE 36-continued

SEQUENCE TABLE

| SEQ ID NO: | DESCRIPTION | SEQUENCE |
|---|---|---|
| 151 | Exemplary anti-C3d antibody, C8D3, CDRL2 | KVS |
| 152 | Exemplary anti-C3d antibody, C8D3, CDRL3 | SQSTHVPYT |
| 153 | Exemplary anti-C3d antibody, C6, heavy chain sequence | QAYLQQSGAELVRPGASVKMSCKASGYTFTSYYMHWVKQTPRQGLEWIGAI YPGNGDTSYNQKFKGKATLTVDKSSSTAYMQLSSLTSEDSAVYFCAKYGSG YWGQGTTVTVSS |
| 154 | Exemplary anti-C3d antibody, C6, light chain sequence | DVVMTQTPLSLPVSLGDQASISCRSSQSLVYSNGNTYLHWYLQKPGQSPKL LIYKVSNRFSGVPDRFSGSGSGTDFILKISRVEAEDLGVYFCSQSTHVPYT FGGGTKLEIKR |
| 155 | Exemplary anti-C3d antibody, C6, CDRH1 | GYTFTSYY |
| 156 | Exemplary anti-C3d antibody, C6, CDRH2 | IYPGNGDT |
| 157 | Exemplary anti-C3d antibody, C6, CDRH3 | AKYGSGY |
| 158 | Exemplary anti-C3d antibody, C6, CDRL1 | QSLVYSNGNTY |
| 159 | Exemplary anti-C3d antibody, C6, CDRL2 | KVS |
| 160 | Exemplary anti-C3d antibody, C6, CDRL3 | SQSTHVPYT |
| 161 | Linker | $(G)_n$ |
| 162 | Linker | KESGSVSSEQLAQFRSLD |
| 163 | Linker | EGKSSGSGSESKST |
| 164 | Linker | $(GGGGS)_n$ |
| 165 | Linker | $(EAAAK)_n$ |
| 166 | Linker | $A(EAAAK)_nA$ |
| 167 | Linker | GSAGSAAGSGEF |
| 168 | Linker | $(XP)_n$ |
| 169 | Linker | $A(EAAAK)_4ALEA(EAAAK)_4A$ |
| 170 | Linker | $(PAS)_n$ |

TABLE 36-continued

SEQUENCE TABLE

| SEQ ID NO: | DESCRIPTION | SEQUENCE |
|---|---|---|
| 171 | Linker | (GS)$_n$ |
| 172 | Linker | GGGGSLVPRGSGGGGS |
| 173 | Linker | GGSGGHMGSGG |
| 174 | Linker | (GGS)$_n$ |
| 175 | Linker | GGSGGGGG |
| 176 | Linker | GGGSEGGGSEGGGSE |
| 177 | Linker | AAGAATAA |
| 178 | Linker | GGSSG |
| 179 | Linker | (GT)$_n$ |
| 180 | Linker | GSSSG |
| 181 | Linker | GSGGGTGGGSG |
| 182 | Linker | GSGGSGGSGGSGGS |
| 183 | Linker | GSGSGSGSGGSG |
| 184 | DAF 1-4 | DCGIPPDVPNAQPALEGRTSFPEDTVITYKCEESFVKIPGEKDSVICLKGS QWSDIEEFCNRSCEVPTRLNSASLKQPYITQNYEPVGTVVEYECRPGYRRE PSLSPKLTCLQNLKWSTAVEFCKKKSCPNPGEIRNGQIDVPGGILFGATIS FSCNTGYKLFGSTSSFCLISGSSVQWSDPLPECREIYCPAPPQIDNGIIQG ERDHYGYRQSVTYACNKGFTMIGEHSIYCTVNNDEGEWSGPPPECRG |
| 185 | CD59 | LQCYNCPNPTADCKTAVNCSSDFDACLITKAGLQVYNKCWKFEHCNFNDVT TRLRENELTYYCCKKDLCNFNEQLEN |
| 186 | Map44 | HTVELNNMFGQIQSPGYPDSYPSDSEVTWNITVPDGFRIKLYFMHFNLESS YLCEYDYVKVETEDQVLATFCGRETTDTEQTPGQEVVLSPGSFMSITFRSD FSNEERFTGFDAHYMAVDVDECKEREDEELSCDHYCHNYIGGYYCSCREGY ILHTDNRTCRVECSDNLFTQRTGVITSPDFPNPYPKSSECLYTIELEEGFM VNLQFEDIFDIEDHPEVPCPYDYIKIKVGPKVLGPFCGEKAPEPISTQSHS VLILFHSDNSGENRGWRLSYRAAGNECPELQPPVHGKIEPSQAKYFFKDQV LVSCDTGYKVLIONVEMDTFQIECLKDGTWSNKIPTCKKNEIDLESELKSE QVTE |
| 187 | MCP 1-4 | CEEPPTFEAMELIGKPKPYYEIGERVDYKCKKGYFYIPPLATHTICDRNHT WLPVSDDACYRETCPYIRDPLNGQAVPANGTYEFGYQMHFICNEGYYLIGE EILYCELKGSVAIWSGKPPICEKVLCTPPPKIKNGKHTFSEVEVFEYLDAV TYSCDPAPGPDPFSLIGESTIYCGDNSVWSRAAPECKVVKCREPVVENGKQ ISGFGKKFYYKATVMFECDKGFYLDGSDTIVCDSNSTWDPPVPKCLK |
| 188 | Exemplary anti-C3d antibody 3d3, CDRH1 | GHSFTNYL |
| 189 | Exemplary anti-C3d antibody 3d3, CDRH2 | INPGSGGT |
| 190 | Exemplary anti-C3d antibody 3d3, CDRH3 | ASYYSNSYAMDY |
| 191 | Exemplary anti-C3d antibody 3d3, CDRL1 | ENIYSY |
| 192 | Exemplary anti-C3d antibody 3d3, CDRl2 | KAK |

TABLE 36-continued

SEQUENCE TABLE

| SEQ ID NO: | DESCRIPTION | SEQUENCE |
|---|---|---|
| 193 | Exemplary anti-C3d antibody 3d3, CDRL3 | QHHYGIPYT |
| 194 | Exemplary anti-C3d antibody 3d3, Heavy chain variable region | QVQLQQSGAELVRPGTSVKVSCKASGHSFTNYLIEWVKQRPGQGLEWIGVI NPGSGGINYNEKFKVKATLIADKSSSTAYMQLSSLISEDSAVYFCASYYSN SYAMDYWGQGTSVTVSS |
| 195 | Exemplary anti-C3d antibody 3d3, Light chain variable region | DIQMIQSPASLSASVGETVTIACRASENIYSYLAWYLQKEGKSPQLLVSKA KTLADGVPSRESGGGSGTQFSLKINSLQPEDFGTFYCQHHYGIPYTEGGGI KLEIK |
| 196 | Exemplary anti-C3d antibody 3d10, CDRH1 | GYAFAHYL |
| 197 | Exemplary anti-C3d antibody 3d10, CDRH2 | INPGIDGT |
| 198 | Exemplary anti-C3d antibody 3d10, CDRH3 | AREELGFAY |
| 199 | Exemplary anti-C3d antibody 3d10, CDRL1 | QDISNH |
| 200 | Exemplary anti-C3d antibody 3d10, CDRL2 | YIS |
| 201 | Exemplary anti-C3d antibody 3d10, CDR13 | QQGDTLPYT |
| 202 | Exemplary anti-C3d antibody 3d10, Heavy Chain variable region | QVQLQQSGAELVRPGTSVKVSCKASGYAFAHYLIEWVKQRPGQGIEWIGVI NPGTDGTNYNEKFKGKATLTADKSSSTAYMHLSSLTSEDSAVYFCAREELG FAYWGQGTLVTVSA |
| 203 | Exemplary anti-Cd3 antibody 3d10, Light chain variable r | DIQMTQSTSSLSASLGDRVTISCRASQDISNHLNWYQQRPDGTVKLLIYYI SRLHSGVPSRFSGSGSGTDYSLTISNLEQEDIATYFCQQGDTLPYTFGGGT TLEIR |
| 204 | Exemplary anti-C3d antibody 3d11, CDRH1 | GYTFTSY |
| 205 | Exemplary anti-C3d antibody 3d11, CDRH2 | SDPSDTYT |

TABLE 36-continued

SEQUENCE TABLE

| SEQ ID NO: | DESCRIPTION | SEQUENCE |
|---|---|---|
| 206 | Exemplary anti-C3d antibody 3d11, CDRH3 | ARPGRVAYYFDY |
| 207 | Exemplary anti-C3d antibody 3d11, CDRL1 | QSLVHSNGNTY |
| 208 | Exemplary anti-C3d antibody 3d11, CDRI2 | KVS |
| 209 | Exemplary anti-C3d antibody 3d11, CDRL3 | FQGSHVPPT |
| 210 | Exemplary anti-C3d antibody 3d11, Heavy chain variable region | QVQLQQPGAELVRPGTSVKISCKASGYTFTSYWMHWVKQRPGQGLEWIGVS DPSDTYTKNNQKFTGKATLTVDTSSSTAYMQLSSLTSEDSAVYYCARPGRV AYYFDYWGQGTTLTVSS |
| 211 | Exemplary anti-C3d antibody 3d11, Light chain variable region | DVLMTQTPLSLPVSLGDQASISCRSSQSLVHSNGNTYLEWYLQKPGQSPKL LIYKVSNRFSGVPDRFSGSGSGTDFTLKISRVEAEDLGVYYCFQGSHVPPT FGGGTKLEIK |
| 212 | Exemplary anti-C3d antibody 3d15, CDRH1 | GYAFTNYL |
| 213 | Exemplary anti-C3d antibody 3d15, CDRH2 | INPGSGGT |
| 214 | Exemplary anti-C3d antibody 3d15, CDRH3 | ATYYSNSFAMDY |
| 215 | Exemplary anti-C3d antibody 3d15, CDRL1 | QSLLNSSNQKNY |
| 216 | Exemplary anti-C3d antibody 3d15, CDRI2 | FAS |
| 217 | Exemplary anti-C3d antibody 3d15, CDRL3 | QQYYSIPFT |
| 218 | Exemplary anti-C3d antibody 3d15, Heavy chain variable region | QVQLQQSGAELVRPGTSVKVSCKASGYAFTNYLIEWIKQRPGQGLEWIGVI NPGSGGTNYNEKFKGKATLTADKSSNTAYMHLSSLTSEDSAVYFCATYYSN SFAMDYWGQGTSVTVSS |

TABLE 36-continued

SEQUENCE TABLE

| SEQ ID NO: | DESCRIPTION | SEQUENCE |
|---|---|---|
| 219 | Exemplary anti-C3d antibody 3d15, Light chain variable region | DIVMTQSPSSLAMSVGQKVTMSCKSSQSLLNSSNQKNYLAWYQQKPGQCPK VLVYFASTRESGVPDRFIGSGSGTDFTLTISSVQAEDLADYFCQQYYSIPF TFGSGTKLEIK |
| 220 | Exemplary anti-C3d antibody 3d16, CDRH1 | GYAFAHYL |
| 221 | Exemplary anti-C3d antibody 3d16, CDRH2 | INPGTDGT |
| 222 | Exemplary anti-C3d antibody 3d16, CDRH3 | AREELGFAY |
| 223 | Exemplary anti-C3d antibody 3d16, CDRL1 | QDISNH |
| 224 | Exemplary anti-C3d antibody 3d16, CDRL2 | YIS |
| 225 | Exemplary anti-C3d antibody 3d16, CDRL3 | QQGDTLPYT |
| 226 | Exemplary anti-C3d antibody 3d16, Heavy chain variable region | QVQLQQSGAELVRPGTSVKVSCKASGYAFAHYLIEWVKQRPGQGLEWIGVI NPGTDGTNYNEKFKGKATLTADKSSSTAYMELSSLTSEDSAVYFCAREELG FAYWGQGTLVTVSA |
| 227 | Exemplary anti-C3d antibody 3d16, Light chain variable region | DIQMTQSTSSLSASLGDRVTISCRASQDISNHLNWYQQRPDGTVKLLIYYI SRLHSGVPSRFSGSGSGTDYSLTISNLEQEDIATYFCQQGDTLPYTFGGGT TLEIR |
| 228 | Exemplary anti-C3d antibody 3d31, CDRH1 | GYSFTDYN |
| 229 | Exemplary anti-C3d antibody 3d31, CDRH2 | INPNYGTT |
| 230 | Exemplary anti-C3d antibody 3d31, CDRH3 | ARNDY |
| 231 | Exemplary anti-C3d antibody 3d31, CDRL1 | QSIVHSNGNTY |

TABLE 36-continued

SEQUENCE TABLE

| SEQ ID NO: | DESCRIPTION | SEQUENCE |
|---|---|---|
| 232 | Exemplary anti-C3d antibody 3d31, CDRL2 | KVS |
| 233 | Exemplary anti-C3d antibody 3d31, CDRL3 | FQGSHVPFT |
| 234 | Exemplary anti-C3d antibody 3d31, Heavy chain variable region | EFQLQQSGPELVKPGASVKLSCKASGYSFTDYNMNWVKQSNGKSLEWIGVI<br>NPNYGTTFYNQKFKGKATLTVDQSSSTAYMQLNSLTSEDSAVYYCARNDYW<br>GRGTTLTVSS |
| 235 | Exemplary anti-C3d antibody 3d31, Light chain variable region | DVLMTQTPLSLEVSLGDQASISCRSSQSIVHSNGNTYLDWYLQRPGQSPKL<br>LIYKVSNRFSGVPDRFSGSGSGTDFTLKISRVEAEDLGITYCFQGSHVPFT<br>FGSGTKLEIK |
| 236 | Kabat EU C22S muIgG1 Fc | VPRDSGCKPCICTVPEVSSVFIFPPKPKDVLTITLTPKVTCVVVDI<br>SKDDPEVQFSWFVDDVEVHTAQTQPREEQFNSTFRSVSELPIMHQD<br>WLNGKEFKCRVNSAAFPAPIEKTISKTKGRPKAPQVYTIPPPKEQM<br>AKDKVSLTCMITDFFPEDITVEWQWNGQPAENYKNTQPIMDTDGSY<br>FVYSKLNVQKSNWEAGNTFTCSVLHEGLHNHHTEKSLSHSPG |
| 237 | Kabat EU S228P/ L235E huIgG4 | ESKYGPPCPPCPAPEFEGGPSVFLFPPKPKDTLMISRTPEVTCVVV<br>DVSQEDPEVQFNWYVDGVEVHNAKTKPREEQFNSTYRVVSVLTVLH<br>QDWLNGKEYKCKVSNYGLPSSIEKTISKAKGQPREPQVYTLPPSQE<br>EMTKNQVSLTCLVKGFYPSDIAVEWESNGQPENNYKTTPPVLDSDG<br>SFFLYSRLTVDKSRWQEGNVFSCSVMHEALHNHYTQKSLSLSLG |
| 238 | C2 IgG1 heavy chain (hole) | QVQLQQPGTELVKPGASVKLSCKASGYTFTSYWMHWVKQRPGQGIEWIGNI<br>NPSNGGTNYNEKFKSKATLTVDKSSSTAYMQLSSLTSEDSAVYYCARRGIR<br>LRHFDYWGQGTTLTVSSAKTTPPSVYPLAPGSAAQTNSMVTLGCLVKGYFP<br>EPVTVTWNSGSLSSGVHTFPAVLQSDLYTLSSSVTVPSSTWPSETVTCNVA<br>HPASSTKVDKKIVPRDCGCKPCICTVPEVSSVFIFPPKPKDVLTITLTPKV<br>TCVVVDISKDDPEVQFSWFVDDVEVHTAQTQPREEQFNSTFRSVSELPIMH<br>QDWLNGKEEKCRVNSAAFPAPIEKTISKTKGRPKAPQVYTIPPPKEQMAKD<br>KVSLSCAITDFFPEDITVEWQWNGQPAENYKNTQPIMDTDGSYFVVSKLNV<br>QKSNWEAGNTFTCSVLHEGLHNHHTEKSLSHSPG |
| 239 | C2 scFv | QVQLQQPGTELVKPGASVKLSCKASGYTFTSYWMHWVKQRPGQGLEWIGNI<br>NPSNGGTNYNEKFKSKATLTVDKSSSTAYMQLSSLTSEDSAVYYCARRGIR<br>LRHFDYWGQGTTLTVSSGGGGSGGGGSGGGGSDIVMTQSHKEMSTSVGDRV<br>SITCKASQDVGTAVAWYQQKPGQSPKLLIYWASTRHTGVPDRFTGSGSGTD<br>FILTISNVQEDLADYFCWYSSYPLIFGAGTKLELK |
| 240 | C2 Fab | QVQLQUGTELVKPGASVKLSCKASGYTFTSYWMHWVKQRPGQGLEWIGNI<br>NPSNGGINYNEKFKSKATLTVDKSSSTAYMQLSSLTSEDSAVYYCARRGIR<br>LRHFDYWGQGTTLIVSSAKTIPPSVYPLAPGSAAQINSMVTLGCLVKGYFP<br>EPVTVIWNSGSLSSGVHTFPAVLQSDLYTLSSSVIVPSSTWPSETVICNVA<br>HPASSTKVDKEIVPRDCG |
| 241 | Exemplary linker | GGGGSGGGGSGGGGS |
| 242 | Exemplary linker | GGGGSGGGGS |
| 243 | 3d29 heavy chain (knob) IgG1 | EVQLQQSGPVLVKPGASVKMSCKASGYTFIDYYMNWVKQSHGKSLEWIGVI<br>NPYNGGTSYNQKFKGKATLIVDKSSRTAYMELNSLISEDSAVYYCSRGGPY<br>WGQGTTLTVSSAKTTPPSVYPLAPGSAAVINSMVIDGCLVKGYFPEPVTVT<br>WNSGSLSSGVHTFPAVLQSDLYTLSSSVTVPSSTWPSETVICNVAHPASST<br>KVDKKIVPRDCGCKPCICTVREVSSVFIFPPKPKDVLTITLIPKVTCVVVD<br>ISKDDPEVQFSWFVDDVEVHTAQTQPREEQFNSTFRSVSELPIMHQDWLNG<br>KEFKCIWNSAAFPAPIEKTISKTKGRPKAPQVYTIPPPKEQMAKDKVSLWC<br>MITDFFPEDITVEWQWNGQPAENYKNIQPIMDTDGSYFVYSKLNVQKSNWE<br>AGNTFTCSVLHEGLHNHHTEKSLSHSPG |

TABLE 36-continued

SEQUENCE TABLE

| SEQ ID NO: | DESCRIPTION | SEQUENCE |
|---|---|---|
| 244 | 3d29 Fab heavy chain | EVQLQQSGPVLVKPGASVKMSCKASGYTFTDYYMNWVKQSHGKSLEWIGVI NPYNGGTSYNQKFKGKATLTVDKSSRTAYMELNSLTSEDSAVYYCSRGGPY WGQGTTLIVSSAKTTPPSVYPLAPGSAAQTNSMVTLGCLVKGYFPEPVTVT WNSGSLSSGVHTFPAVLQSDLYTLSSSVTVPSSTWPSETVTCNVARPASST KVDKKIVPRDCG |
| 245 | murine IgG1 Fc (knob) | CKPCICTVPEVSSVFIFPPKPKDVLTITLTPKVTCVVVDISKDDPEVQFSW FVDDVEVHTAQTQPREEQFNSTFRSVSELPIMHQDWLNGKEFKCRVNSAAF PAPIEKTISKTKGRPKAPQVYTIPPPKEQMAKDKVSLWCMITDFFPEDITV EWQWNGQPAENYKNTQPIMDTDGSYFVYSKLNVQKSNWEAGNIFTCSVLHE GLHNHHTEKSLSESPG |
| 246 | Exemplary humanized-AMX02_3d8b_VH1_aa | EVQLVQSGPVVVKPGASVKMSCKASGYTFTNYYINVVKQAHGQGLE WIGVINPYNGGTSYNQKFKGRATLTVDKSSSTAYMELSSLRSEDTA VYFCSSPYWGQGTLVTVSS |
| 247 | Exemplary humanized-AMX02_3d8b_VH2_aa | EVQLVQSGAVVKKPGASVKMSCKASGYTFTNYYINVVKQAPGQGLE WIGVINPYNGGTSYNQKFKGRATLTVDKSSSTAYMELSSLRSEDTA VYFCSSPYWGQGTLVTVSS |
| 248 | Exemplary humanized-AMX02_3d8b_VH3_aa | EVQLVQSGAEVKKPGASVKVWSCKASGYTFTNYYINWRQAPGQGLE WIGVINPYNGGTSYNQKFKGRATLTVDKSSSTAYMELSSLRSEDTA VYFCSSPYWGQGTLVTVSS |
| 249 | Exemplary humanized-AMX02_3d8b_VH4_aa | QVQLVQSGAEVKKPGASVKVSCKASGYTFTNYYINWVRQAPGQGLE WIGVINPYNGGTSYNQKFKGRATLTVDTSTSTAYMELSSLRSEDTA VYFCSSPYWGQGTLVTVSS |
| 250 | Exemplary humanized-AMX02_3d8b_VH4_N54H_aa | QVQLVQSGAEVKKPGASVKVSCKASGYTFTNYYINWVRQAPGQGLE WIGVINPYHGGTSYNQKFKGRATLTVDTSTSTAYMELSSLRSEDTA VYFCSSPYWGQGTLVTVSS |
| 251 | Exemplary humanized-AMX02_3d8b_VH4_N54S_aa | QVQLVQSGAEVKKPGASVKVSCKASGYTFTNYYINWVRQAPGQGLE WIGVINPYSGGTSYNQKFKGRATLTVDTSTSTAYMELSSLRSEDTA VYFCSSPYWGQGTLVTVSS |
| 252 | Exemplary humanized-AMX02_3d8b_VH5_aa | QVQLVQSGAEVKKPGASVYVSCKASGYTFTNYYINWVRQAPGQGLE WMGVINPYNGGTSYNQKFKGRVTMTVDTSTSTAYMELSSLRSEDTA VYFCSSPYWGQGTLVTVSS |
| 253 | Exemplary humanized-AMX02_3d8b_VH5_N54H_aa | QVQLVQSGAEVKKPGASVKVSCKASGYTFTNYYINWVRQAPGQGLE WMGVINPYHGGTSYNQKFKGRVTMTVDTSTSTAYMELSSLRSEDTA VYFCSSPYWGQGTLVTVSS |
| 254 | Exemplary humanized-AMX02_3d8b_VH5_N5LS_aa | QVQLVQSGAEVKKPGASVKVSCKASGYTFTNYYINWVRQAPGQGLE WMGVINPYSGGTSYNQKFKGRVTMTVDTSTSTAYMELSSLRSEDTA VYFCSSPYWGQGTLVTVSS |
| 255 | Exemplary humanized-AMX02_3d8b_VH6_aa | QVQLVQSGAEVKKPGASVKVSCKASGYTFTNYYINWVRQAPGQGLE WMGVINPYNGGTSYNQKFKGRVTMTRDTSTSTVYMELSSLRSEDTA VYFCSSPYWGQGTLVTVSS |
| 256 | Exemplary humanized-AMX02_3d8b_VK1_aa | DVVMTQSPLSLPVTLGQPASISCKSSQSLLDSDGKTYLNWLLQRPG QSPKRLIYLVSKLDSGVPDRFSGSGSGTDFTLKISRVEAEDVGVYY CWQGTHFPRTFGGGTKLEIK |
| 257 | Exemplary humanized-AMX02_3d8b_VK2_aa | DVVMTQSPLSLPVTLGQPASISCKSSQSLLDSDGKTYLNWLQQRPG QSPRRLIYLVSKLDSGVPDRFSGSGSGTDFTLKISRVEAEDVGVYY CWQGTHFPRTFGGGTKVEIK |

TABLE 36-continued

| SEQ ID NO: | DESCRIPTION | SEQUENCE |
|---|---|---|
| 258 | Exemplary humanized-AMX02_3d8b_VK3_aa | DVVMTQSPLSLPVTLGQPASISCKSSQSLLDSDGKTYLNWFQQRPGQSPRRLIYLVSKLDSGVPDRFSGSGSGTDFTLKISRVEAEDVGVYYCWQGTHFPRTFGGGTKVEIK |
| 259 | Exemplary CDRH2 3d8b | INPYHGGT |
| 260 | Exemplary CDRH2 3d8b | INPYSGGT |
| 261 | Exemplary humanized-AMX01_C2_VH1_aa | QVQLQQPGTELKKPGASVYLSCKASGYTFTSYWMHWVKQRPGQGLEWIGNINPSNGGTNYNEKFKSRATLTVDKSTSTAYMELSSLRSEDSAVYYCARRGIRLRHFDYWGQGTTVTVSS |
| 262 | Exemplary humanized-AMX01_C2_VH2_aa | QVQLVQSGAEVKKPGASVKLSCKASGYTFTSYWMHWVKQRPGQGLEWIGNINPSNGGTNYNEKFKSRATLTVDKSTSTAYMELSSLRSEDTAVYYCARRGIRLRHEDYWGQGTTVTVES |
| 263 | Exemplary humanized-AMX01_C2_VH3_aa | QVQLVQSGAEVKKPGASVEVSCKASGYTFTSYWMHWVRQAPGQGLEWIGNINPSNGGTNYNEKFKSRATLTVDKSTSTAYMELSSLRSEDTAVYYCARRGIRLRHFDYWGQGTTVTVSS |
| 264 | Exemplary humanized-AMX01_C2_VH4_aa | QVQLVQSGAEVKKPGASVKVSCKASGYTFTSYWMHWVRQAPGQGLEWIGNINPSNGGTNYNEKFKSRVTMTVDKSTSTAYMELSSLRSEDTAVYYCARRGIRLRHFDYWGQGTTVTVSS |
| 265 | Exemplary humanized-AMX01_C2_VH5_aa | QVQLVQSGAEVKKPGASVKVSCKASGYTFTSYWMHWVRQAPGQGLEWIGNINPSNGGTNYNEKFQGRVTMTVDKSTSTAYMELSSLRSEDTAVYYCARRGIRLRHFDYWGQGTTVTVSS |
| 266 | Exemplary humanized-AMX01_C2_VK1_aa | DIVMTQSPSFLSASVGDRVTITCKASQDVGTAVAWYQQKPGKAPKILIYWASTRHTGVPDRFTGSGSGTDFTLTISSLQSEDFADYFCQQYSSYPLTFWGTKLEIK |
| 267 | Exemplary humanized-AMX01_C2_VK2_aa | DIVMTQSPSFLSASVGDRVTITCKASQDVGTAVAWYQQKPGKAPKLLIYWASTRHTGVPDRFSGSGSGTDFTLTISSLQPEDFADYFCQQYSSYPLTFWGTKLEIK |
| 268 | Exemplary humanized-AMX01_C2_VK3_aa | DIQMTQSPSFLSASVGDRVTITCKASQDVGTAVAWYQQKPGKAPKLLIYWASTRHTGVPSRFSGSGSGTEFTLTISSLQPEDFADYFCQQYSSYPLTFGQGTKLEIK |
| 269 | Exemplary humanized-AMX01_C2_VK4_aa | DIQLTQSPSFLSASVGDRVTITCKASQDVGTAVAWYQQKPGKAPKLLIYWASTRHTGVPSRFSGSGSGTEFTLTISSLQPEDFADYFCQQYSSYPLTFGQGTKLEIK |
| 270 | Exemplary humanized-AMX01_B4_VH1_aa | EVQLQQSGPELKKPGASVKISCKASGYTFTDYYMNWVKQAHGQGLEWIGDINPNNGGTSYNQKFKGRATLTVDKSSTAYMELRSLTSEDSAVYYCARYDYAWYFDVWWGTTVTVSS |
| 271 | Exemplary humanized-AMX01_B4_VH2_aa | EVQLVQSGAEVKKPGASVKISCKASGYTFTDYYMNWVKQAHGQGLEWIGDINPNNGGTSYNQKFKGRATLTVDKSSTAYMELSSLRSEDTAVYYCARYDYAWYEDVWGQGTTVTVSS |

TABLE 36-continued

SEQUENCE TABLE

| SEQ ID NO: | DESCRIPTION | SEQUENCE |
| --- | --- | --- |
| 272 | Exemplary humanized-AMX01_B4_VH3_aa | EVQLVQSGAEVKKPGASVEVSCKASGYTFTDYYMNWVRQAPGQGLEWIGDINPNNGGTSYNQKFKGRATLTVDKSSSTAYMELSSLRSEDTAVYYCARYDYAWYFEWWWGTTVTVSS |
| 273 | Exemplary humanized-AMX01_B4_V44_aa | EVQLVQSGAEVKKPGASVKVSCKASGYTFTDYYMNWVRQAPGQGLEWIGDINPNNGGTSYNQKFKGRVTMTVDKSSSTAYMELSSLRSEDTAVYYCARYDYAWYFDVWWGTTVTVSS |
| 274 | Exemplary humanized-AMX01_B4_VH5_aa | EVQLVQSGAEVKKPGASVKVSCKASGYTFTDYYMNWVRQAPGQGLEWIGDINPNNGGTSYNQKFQGRVTMTVDKSSSTAYMELSSLRSEDTAVYYCARYDYAWYEDVWGQGTTVTVSS |
| 275 | Exemplary humanized-AMX01_B4_VK1_aa | DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQSHVPYTEGQTKLEIK |
| 276 | Exemplary humanized-AMX01_B4_VK2_aa | DVVMTQSPLSLPVTLGQPASISCRSSQSIVHSNGNTYLEWYQQRPGQSPRILIYKVSNRFSGVPDRFSGSGSGTDFTIKISRVEAEDVGVYYCFQGSHVPYTEGQGTKLEIK |
| 277 | Exemplary humanized-AMX01_B4_VK3_aa | DVVMTQSPLSLPVTLGQPASISCRSSQSIVHSNGNTYLEWFQQRPGQSPRLLIYKVSNRFSGVPDRFSGSGSGTDFILKISRVEAEDVGVYYCFQGSHVPYTEGQGTKLEIK |
| 278 | Exemplary humanized-AMX01_B4_VK4_aa | DVVMTQSPLSIPVTIGQPASISCRSSQSIVHSNGNTYLEWYQQRPGQSPRRLIYKVSNRFSGVPDRFSGSGSGTDFTLKISRVEAEDVGVYYCFQGSHVPYTEGQGTKLEIK |
| 279 | LC1 Light Chain Sequence (Vk3), humanized IgG4 kappa | DVVMTQSPLSLPVTLGQPASISCKSSQSLLDSDGKTYLNWFQQRPGQSPRRLIYLVSKLDSGVPDRFSGSGSGTDFTLKISRVEAEDVGVYYCWQGTHFPRTEGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| 280 | HC1 Heavy Chain Sequence (VH5), humanized IgG4 with hinge stabilizing/effector function (S228P/L235E) | QVQLVQSGAEVKKPGASVKVSCKASGYTFTNYYINWVRQAPGQGLEWMGVINPYNGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVIQSSGLYSISSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGEYPSDIAVEWESNGQPENNYKTTPPVLDSDGSFFLYSRLTVDKSRWQEGNVFSCSVMHEALHNHYTQKSLSLSLG |
| 281 | HC2 Heavy Chain Sequence (VH5), humanized IgG4 with hinge stabilizing/effector function (S228P/L235E), enhanced FcRn binding (M426L/N434S) | QVQLVQSGAEVKKPGASVKVSCKASGYTFTNYYINWVRQAPGQGLEWMGVINPYNGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVIQSSGLYSLSSVVTVPSSSLGTKTYTCNVDHKPSNTKVDKRVESKYGPPCPPCPABEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLG |

TABLE 36-continued

SEQUENCE TABLE

| SEQ ID NO: | DESCRIPTION | SEQUENCE |
|---|---|---|
| 282 | HC3 Heavy Chain Sequence (VH5), humanized IgG4 with hinge stabilizing/ effector function (S228P/L235E), enhanced FcRn binding (M428L/N434S), deamidation (N54S) | QVQLVQSGAEVKKPGASVKVSCKASGYTFTNYYINWVRQAPGQGLE WMGVINPYSGGTSYNQKFKGRVTMTVDTSTSTAYMELSSLRSEDTA VYFCSSPYWGQGTLVTVSSASTKGPSVFPLAPCSRSTSESTAALGC LVKDYFPEPVTVSWNSGALTSGVHTFPAVIQSSGLYSLSSVVTVPS SSLGTKTYTCNVDHKPSNTKVDKRVESKYGPPCPPCPAPEFEGGPS VFLEPPKPKDTLMISRTPEVTCVVVDVSQEDPEVQFNWYVDGVEVH NAKTKPREEQFNSTYRVVSVLTVLHQDWLNGKEYKCKVSNKGLPSS IEKTISKAKGQPREPQVYTLPPSQEEMTKNQVSLTCLVKGFYPSDI AVEWESNGQPENNYKTTPPVLDSDGSFFLYSRLTVDKSRWQEGNVF SCSVLHEALHSHYTQKSLSLSLG |
| 237 | HC4 Heavy Chain Sequence, humanized IgG4 Fc with hinge stabilizing/ effector function (S228P/L235E) | ESKYGPPCPPCPAPEFEGGPSVFLFPPKPKDTLMISRTPEVTCVVV DVSQEDPEVQFNWYVDGVEVHNAKTKPREEQFNSTYRVVSVLTVLH QDWLNGKEYKCKVSNKGLPSSIEKTISKAKGQPREPQVYTLPPSQE EMTKNQVSLTCLVKGFYPSDIAVEWESNGQPENNYKTTPPVLDSDG SFFLYSRLTVDKSRWQEGNVESCSVMHEALHNHYTQKSLSLSLG |
| 283 | HC5 Heavy Chain Sequence, humanized IgG4 Fc with hinge stabilizing/ effector function (S228P/L235E), enhanced FcRn binding (M428L/N434S) | ESKYGPPCPPCPAPEFEGGPSVFLFPPKPKDTIMISRTPEVTCVVV DVSQEDPEVQFNWYVDGVEVHNAKTKPREEQFNSTYRVVSVLTVIH QDWLNGKEYKCKVSNKGLPSSIEKTISKAKGQPREPQVYTLPPSQE EMTKNQVSLTCLVKGFYPSDIAVEWESNGQPENNYKTTPPVLDSDG SFFLYSRLTVDKSRWQEGNVESCSVLHEALHSHYTQKSLSLSLG |
| 284 | HC6 Heavy Chain Sequence (VH5), humanized IgG4 VH1 (N54S) CH1 | QVQLVQSGAEVKKPGASVKVSCKASGYTFTNYYINWVRQAPGQGLE WMGVINPYSGGTSYNQKFKGRVTMTVDTSTSTAYMELSSLRSEDTA VYFCSSPYWGQGTLVTVSSASTKGPSVFPLAPCSRSTSESTAALGC LVKDYFPEPVTVSWNSGALTSGVHTFPAVLQSSGLYSLSSVVTVPS SSLGTKTYTCNVDHKPSNTKVDKRVESKYG |
| 285 | HC7 Heavy Chain Sequence (VH5), humanized IgG4 with hinge stabilizing/ effector function (S228P/L235E), deamidation (N54S) | QVQLVQSGAEVKKPGASVYVSCKASGYTFTNYYINWVRQAPGQGLE WMGVINPYSGGTSYNQKFKGRVTMTVDTSTSTAYMELSSLRSEDTA VYFCSSPYWGQGTLVTVSSASTKGPSVFPLAPCSRSTSESTAALGC LVKDYFPEPVTVSWNSGALTSGVHTFPAVLQSSGLYSLSSVVTVPS SSLGTKTYTCNVDHKPSNTKVDKRVESKYGPPCPPCPAPEFEGGPS VFLFPPKPKDTLMISRTPEVTCVVVDVSQEDPEVQFNWYVDGVEVH NAKTKPREEQFNSTYRVVSVLTVLHQDWLNGKEYKCKVENKGLPSS IEKTISKARGQPREPQVYTLPPSQEEMTKNQVSLTCLVKGFYPSDI AVEWESNGQPENNYKTTPPVLDSDGSFFLYSRLTVDKSRWQEGNVF SCSVMHEALHNHYTQKSLSLSLG** |

TABLE 36-continued

SEQUENCE TABLE

| SEQ ID NO: | DESCRIPTION | SEQUENCE |
|---|---|---|
| 286 | HC8 Heavy Chain Sequence (VH5), humanized IgG4 with hinge stabilizing/ effector function (S228P/L235E), enhanced FcRn binding (M428L/N434S), deamidation (N54S), triple histidine (V2H/T30H/ T73H) | QHQLVQSGAEVKKPGASVKVSCKASGYTFHNYYINWVRQAPGQGLE WMGVINPYSGGTSYNQKFKGRVTMTVDHSTSTAYMELSSLRSEDTA VYFCSSPYWGQGTLVTVSSASTKGPSVFPLAPCSRSTSESTAALGC LVKDYFPEPVTVSWNSGALTSGVHTFPAVLQSSGLYSLSSVVTVPS SSLGTKTYTCNVDHKPSNTKVDKRVESKYGPPCPPCPAPEFEGGPS VFLFPPKPKDTLMISRTPEVTCVVVDVSQEDPEVQFNWYVDGVEVH NAKTKPREEQFNSTYRVVSVLTVLHQDWLNGKEYKCKVSNKGLPSS IEKTISKAKGQPREPQVYTLPPSQEEMTKNQVSLTCLVKGEYPSDI AVEWESNGQPENNYKTTPPVLDSDGSFFLYSRLTVDKSRWQEGNVF SCSVLHEALHSHYTQKSLSLSLG** |
| 68 | muLC1 Light Chain Sequence, murine kappa | DVVMTQTPLTLSVTIGQPASISCKSSQSLLDSDGKTYLNWLLQRPG QSPKRLIYLVSKLDSGVPDRFTGSGSGTDFTLKISRVEAEDIGVYY CWQGTHFPRTFGGGTKLEIRRADAAPTVSIFPPSSEQLTSGGASVV CFLNNFYTKDINVKWKIDGSERQNGVLNSWTDQDSKDSTYSMSSTL TLTKDEYERHNSYTCEATHKTSTSPIVKSFNRNEC** |
| 73 | muHC1 Heavy Chain Sequence, murine IgG1 | EVQLQQSGPVLVKPGASVKMSCKASGYTFTNYYINWVKQSHGKSLE WIGVINPYNGGTSYNQKFKGKATLTVDKSSSTAYMELNSLTSEDSA VYFCSSPYWGQGTSVTVSSAKTTPPSVYPLAPGSAAQTNSMVIIGC LVKGYFPEPVTVTWNSGSLSSGVHTFPAVIQSDLYTLSSSVTVPSS TWPSETVTCNVAHPASSTKVDKKIVPRDCGCKPCICTVPEVSSVFI FPPKPKDVLTITLTPKVTCVVVDISKDDPEVQFSWFVDDVEVHTAQ TQPREEQFNSTERSVSELPIMHQDWLNGKEFKCRVNSAAFPAPIEK TISKTKGRPKAPQVYTIPPPKEQMAKDKVSLTCMITDFFPEDITVE WQWNGQPAENYKNTQPIMDTDGSYFVYSKLNVQKSNWEAGNTFTCS VLHEGLHNHHTEKSLSHSPG** |
| 287 | muLC2 Light Chain Sequence, murine kappa | DVVMTQTPLTLSVTIGQPASISCKSSQSLLDSDGKTYLNWLLQRPG QSPKRLIYLVSKVDSGVPDRFTGSGSGTDFTLKINRVEAEDLGVYY CWQGTHFPRTFGGGTKLEIKRADAAPTVSIFPPSSEQLTSGGASVV CFLNNFYPKDINVKWKIDGSERQNGVLNSWTDQDSKDSTYSMSSTL TLTKDEYERHNSYTCEATHKTSTSPIVKSENRNEC** |
| 288 | muHC2 Heavy Chain Sequence, murine IgG1 | EVQLQQSGPVLVKPGASVKMSCKASGYTFTAYYMNWVRQSHGKSLE WIGVINPYNGGTSYNQKFKGKATLTVDKSSSTAYMELNSLTSEDSA VYYCSSPYWGQGTSVTVSSAKTTPPSVYPLARGSAAQTNSMVTLGC LVKGYFPEPVTVTWNSGSLSSGVHTFPAVLQSDLYTLSSSVTVPSS TWPSETVTCNVAHPASSTKVDKKIVPRDCGCKPCICTVFEVSSVFI FPPKPKDVLTITLTPKVTCVVVDISKDDPEVQFSWFVDDVEVHTAQ TQPREEQFNSTERSVSELPIMHQDWLNGKEEKCRVNSAAFPAPIEK TISKTKQRPKAPQVYTIPPPKEQMAKDKVSLTCMITDFFPEDITVE WQWNGQPAENYYNTQPIMDTDGSYFVYSKLNVQKSNWEAGNTFTCS VLHEGLHNHHTEKSLSHSPG** |
| 59 | muLC3 Light Chain Sequence, murine kappa | DVVMTQTPLTLSVTIGQPASISCKSSQSLLDSDGKTYLNWLLQRPG QSPKRLTYLVSKLESGVPDRFTGSGSGTDFTLEISRVEAEDLGVYY CWQGTHFPRTEGGGTKLEIKRADAA2TVSIFPPSSEQLTSGGASVV CFLNNFYPKDINVKWKIDGSERQNGVLNSWTDQDSKDSTYSMSSTL TLTKDEYERHNSYTCEATHKTSTSPIVKSFNRNEC** |

TABLE 36-continued

SEQUENCE TABLE

| SEQ ID NO: | DESCRIPTION | SEQUENCE |
|---|---|---|
| 244 | muHC3 Heavy Chain Sequence, murine IgG1 Fd (VH1 + CH1 + partial hinge) (truncated hinge contains VPRDCG (SEQ ID NO: 300)) | EVQLQQSGPVLVKPGASVKMSCKASGYTFTDYYMNWVKQSHGKSLE WIGVINPYNGGTSYNQKFKGKATLTVDKSSRTAYMELNSLTSEDSA VYYCSRGGPYWGQGTTLTVSSAKTTPPSVYPLAPGSAAQTNSMVTL GCLVKGYFPEPVTVTWNSGSLSSGVHTFPAVLUDLYTELSSSVTVP SSTWPSETVTCNVAHPASSTKVDKKIVPRDCG** |
| 289 | muLC4 Light Chain Sequence, murine kappa | NIMMTQSPSSLAVSAGEKVTMSCKSSQSVLYSSNQKNYLAWYQQKP GQSPKLLIYWASTRESGVPDRFTGSGSGTDFTLTISSVQAEDLAVY YCHQYLSSRTEGGGTKLEIKRADAAPTVSIFPPSSEQLTSGGASVV CFLNNEYPKDINVKWKIDGSERQNGVLNSWTDQDSKDSTYSMSSTL TLTKDEYERHNSYTCEATHKTSTSPIVKSFNRNEC** |
| 290 | muHC4 Heavy Chain Sequence, murine IgG1 | QVQLQQPGAELVRPGTSVKLSCKASGYTFTSSWMHWVKQRPGQGLE WIGVIDPSDSYTNYNQKFKGKATLTVDTSSSTAYMQLSSLTSEDSA VYYCARGGGSSYNRYFDVWGTGTTVTVSSAKTTPPSVYPLAPGSAA QTNSMVTLGCLVKGYFPEPVTVTWNSGSLSSGVHTFPAVLQSDLYT LSSSVTVPSSTWPSETVTCNVAHPASSTKVDKKIVPRDCGCKPCIC TVPEVSSVFIFPPKPKDVLTITLTPKVTCVVVDISKDDPEVQFSWF VDDVEVHTAQTQPREEQFNSTERSVSELPIMHQDWLNGKEEKCRVN SAAFPAPIEKTISKTKGRPKAPQVYTIPPPKEQMAKDKVSLTCMIT DFFPEDITVEWQWNGQPAENYKNTQPIMDTDGSYFVYSKLNVQKSN WEAGNTFTCSVLHEGLHNHHTEKSLSHSPG** |
| 291 | E3m murine Factor H (1-5), Short Consensus Repeats 1-5: fH1-5 sequence | EDCKGPPPRENSEILSGSWSEQLYPEGTQATYKCRPGYRTLGTIVK VCKNGKWVASNPSRICRKKPCGHPGDTPFGSFRLAVGSQFEFGAKV VYTCDDGYQLLGEIDYRECGADGWINDIPLCEVVYCLPVTELENGR IVSGAAETDQEYYFGQVVRFECNSGFKIEGHKEIHCSENGLWSNEK PRCVEILCTPPRVENGDGINVKPVYKENERYHYKCKHGYVPKERGD AVCTGSGWSSQPFCEEKRCSPPYILNGIYTPHRIIHRSDDEIRYEC NYGFYPVTGSTVSKCTPTGWIPVPRCTLK** |
| 301 | Exemplary epitope sequence | GSGSGSGRLGREGVQ |
| 302 | Exemplary epitope sequence | GREGVQKEDIPPADL |
| 303 | Exemplary epitope sequence | IPPADLSDQVPDTES |
| 304 | Exemplary epitope sequence | VPDTESETRILLQGT |
| 305 | Exemplary epitope sequence | ILLQGTPVAQMTEDA |
| 306 | Exemplary epitope sequence | QMTEDAVDAERLKHL |
| 307 | Exemplary epitope sequence | ERLKHLIVTPSGCGE |
| 308 | Exemplary epitope sequence | PSGCGEQNMIGMTPT |

TABLE 36-continued

| SEQ ID NO: | DESCRIPTION | SEQUENCE |
|---|---|---|
| 309 | Exemplary epitope sequence | IGMTPTVIAVHYLDE |
| 310 | Exemplary epitope sequence | VEYLDETEQWEKEGL |
| 311 | Exemplary epitope sequence | WEKFGLEKRQGALEL |
| 312 | Exemplary epitope sequence | QGALELIKKGYTQQL |
| 313 | Exemplary epitope sequence | GYTQQLAFRQPSSAF |
| 314 | Exemplary epitope sequence | QPSSAFAAFVKRAPS |
| 315 | Exemplary epitope sequence | VKRAPSTWLTAYVVK |
| 316 | Exemplary epitope sequence | TAYVVKVFSLAVNLI |
| 317 | Exemplary epitope sequence | LAVNLIAIDSQVLCG |
| 318 | Exemplary epitope sequence | SQVLCGAVKWLILEK |
| 319 | Exemplary epitope sequence | WLILEKQKPDGVFQE |
| 320 | Exemplary epitope sequence | DGVFQEDAPVIHQEM |
| 321 | Exemplary epitope sequence | VIHQEMIGGLRNNNE |
| 322 | Exemplary epitope sequence | LRNNNEKDMALTAFV |
| 323 | Exemplary epitope sequence | ALTAFVLISLQEAKD |
| 324 | Exemplary epitope sequence | LQEAKDICEEQVNSL |
| 325 | Exemplary epitope sequence | EQVNSLPGSITKAGD |
| 326 | Exemplary epitope sequence | ITKAGDFLEANYMNL |
| 327 | Exemplary epitope sequence | ANYMNLQRSYTVAIA |

TABLE 36-continued

SEQUENCE TABLE

| SEQ ID NO: | DESCRIPTION | SEQUENCE |
|---|---|---|
| 328 | Exemplary epitope sequence | YTVAIAGYALAQMGR |
| 329 | Exemplary epitope sequence | LAQMGRIKGPLLNKF |
| 330 | Exemplary epitope sequence | PLLNKFLTTAKDKNR |
| 331 | Exemplary epitope sequence | AKDKNRWEDPGKQLY |
| 332 | Exemplary epitope sequence | PGKQLYNVEATSYAL |
| 333 | Exemplary epitope sequence | ATSYALLALLQLKDF |
| 334 | Exemplary epitope sequence | LQLKDFDFVPPVVRW |
| 335 | Exemplary epitope sequence | PPVVRWLNEQRYYGG |
| 336 | Exemplary epitope sequence | QRYYGGGYGSTQATF |
| 337 | Exemplary epitope sequence | STQATFMVFQALAQY |
| 338 | Exemplary epitope sequence | QALAQYQKDAPDHQE |
| 339 | Exemplary epitope sequence | APDHQELNLDVSLQL |
| 340 | Exemplary epitope sequence | DVSLQLPSRSSKITH |
| 341 | Exemplary epitope sequence | IVTPSGSGEQNMIGM |
| 342 | muHC7 Heavy Chain Sequence, murine IgG2b | EVQLQQSGPVLVKPGASVKMSCKASGYTFTAYYMNWVRQSHGKSLE WIGVINPYNGGTSYNQKFKGKATLTVDKSSSTAYMELNSLTSEDSA VYYCSSPYWGQGTSVTVSSAKTTPPSVYPLAPGCGDTTGSSVTLGC INKGYFPESVTVIWNSGSLSSSVHTFPALLQSGLYTMSSSVTVPSS TWPSQTVTCSVAHPASSTTVDKKLEPSGPISTINPCPPCKECHKCP APNLEGGPSVFIFPPNIKDVLMISLTPKVTCVVVDVSEDDPDVRIS WFVNNVEVHTAQTQTHREDYNSTIRVVSALPIQHQDWMSGKEFKCK VNNKDLPSPIERTISKIKGLVRAPQVYILPPPAEQLSRKDVSLTCL VVGFNPGDISVEWTSNGHTEENYKDTAPVLDSDGSYFIYSKLDIKT SKWEKTDSIFSCNVRHEGLKNYYLKKTISRSPGK** |
| 343 | Exemplary anti-C3d antibody 3d11, CDRH1 | GYTFTSYW |

Key = In SEQ ID Nos.: 161, 164, 165, 166, 168, 170, 171, 174, and 179 n ranges from 0 to 17, 1 to 8, 1 to 5, at least 4, or 5 to 17,

SEQUENCE LISTING (343 sequences)

SEQ ID NO: 1 - protein, 392 aa, Homo sapiens [sequence omitted]

SEQ ID NO: 2 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 3 - protein, 390 aa, Mus musculus
MIRGRAPRTRPSPPPPLLPLLSLSLLLLSPTVRGDCGPPPDIPNARPILGRHSKFAEQSKVAYSCNNGFKQVPDKSNIVVCLENGQWSSHETFCEKSCVAPERLSFASLKKEYLNMNFFPVGTIVEYECRPGFRKQPPLPGKATCLEDLVWSPVAQFCKKKSCPNPKDLDNGHINIPTGILFGSEINFSCNPGYRLVGVSSTFCSVTGNTVDWDDEFPVCTEIHCPEPPKINNGIMRGESDSYTYSQVVTYSCDKGFILVGNASIYCTVSKSDVGQWSSPPPRCIEKSKVPTKKPTINVPSTGTPSTPQKPTTESVPNPGDQPTPQKPSTVKVSATQHVPVTKTTVRHPIRTSTDKGEPNTGGDRYIYGHTCLITLTVLHVMLSLIGYLT

SEQ ID NO: 4 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 5 - protein, 123 aa, Mus musculus
MRAQRGLILLLLLLAVFCSTAVSLTCYHCFQPVVSSCNMNSTCSPDQDSCLYAVAGMQVYQRCWKQSDCHGEIIMDQLEETKLKFRCCQFNLCNKSDGSLGKTPLLGTSVLVAILNLCFLSHL

SEQ ID NO: 6 - protein, 129 aa, Mus musculus
MRAQRGLILLLLLLAVFCSTAVSLKCYNCLDPVSSCKINTTCSPNLDSCLYAVAGRQVYQQCWKLSDCNSNYIMSRLDVAGIQSKCCQWDLCNKNLDGLEEPNNAETSSLRKTALLGTSVLVAILKFCF

SEQ ID NO: 7 - protein, 483 aa, Mus musculus
MEVSSRSSEPLDPVWLLVAFGRGGVKLEVLLLFLLPFTLGELRGGLGKHGHTVHREPAVNRLCADSKRWSGLPVSAQRPFPMGHCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSISGLIVGIFIGIIVFILVIIVFIWMILKYKKRNTTDEKYKEVGIHLNYKEDSCVRLQSLLTSQENSSTTSPARNSLTQEVS

SEQ ID NO: 8 - protein, 2039 aa, Homo sapiens
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 9 - protein, 1231 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 10 - protein, 1234 aa, Mus musculus
MRLSARIIWLILWTVCAAEDCKGPPPRENSEILSGSWSEQLYPEGTQATYKCRPGYRTLGTIVKVCKNGKWVASNPSRICRKKPCGHPGDTPFGSFRLAVGSQFEFGAKVVYTCDDGYQLLGEIDYRECGADGWINDIPLCEVVKCLPVTELENGRIVSGAAETDQEYYFGQVVRFECNSGFKIEGHKEIHCSENGLWSNEKPRCVEILCTPPRVENGDGINVKPVYKENERYHYKCKHGYVPKERGDAVCTGSGWSSQPFCEEKRCSPPYILNGIYTPHRIIHRSDDEIRYECNYGFYPVTGSTVSKCTPTGWIPVPRCTLKPCEFPQFKYGRLYYEESLRPNFPVSIGNKYSYKCDNGFSPPSGYSWDYLRCTAQGWEPEVPCVRKCVFHYVENGDSAYWEKVYVQGQSLKVQCYNGYSLQNGQDTMTCTENGWSPPPKCIRIKTCSASDIHIDNGFLSESSSIYALNRETSYRCKQGYVTNTGEISGSITCLQNGWSPQPSCIKSCDMPVFENSITKNTRTWFKLNDKLDYECLVGFENEYKHTKGSITCTYYGWSDTPSCYERECSVPTLDRKLVVSPRKEKYRVGDLLEFSCHSGHRVGPDSVQCYHFGWSPGFPTCKGQVASCAPPLEILNGEINGAKKVEYSHGEVVKYDCKPRFLLKGPNKIQCVDGNWTTLPVCIEEERTCGDIPELEHGSAKCSVPPYHHGDSVEFICEENFTMIGHGSVSCISGKWTQLPKCVATDQLEKCRVLKSTGIEAIKPKLTEFTHNSTMDYKCRDKQEYERSICINGKWDPEPNCTSKTSCPPPPQIPNTQVIETTVKYLDGEKLSVLCQDNYLTQDSEEMVCKDGRWQSLPRCIEKIPCSQPPTIEHGSINLPRSSEERRDSIESSSHEHGTTFSYVCDDGFRIPEENRITCYMGKWSTPPRCVGLPCGPPPSIPLGTVSLELESYQHGEEVTYHCSTGFGIDGPAFIICEGGKWSDPPKCIKTDCDVLPTVKNAIIRGKSKKSYRTGEQVTFRCQSPYQMNGSDTVTCVNSRWIGQPVCKDNSCVDPPHVPNATIVTRTKNKYLHGDRVRYECNKPLELFGQVEVMCENGIWTEKPKCRDSTGKCGPPPPIDNGDITSLSLPVYEPLSSVEYQCQKYYLLKGKKTITCRNGKWSEPPTCLHACVIPENIMESHNIILKWRHTEKIYSHSGEDIEFGCKYGYYKARDSPPFRTKCINGTINYPTCV

SEQ ID NO: 11 - protein, 8 aa, Artificial Sequence
  Description of Artificial Sequence: Synthetic peptide
GYTFTDYY

SEQ ID NO: 12 - protein, 8 aa, Artificial Sequence
  Description of Artificial Sequence: Synthetic peptide
INPNNGGT

SEQ ID NO: 13 - protein, 11 aa, Artificial Sequence
  Description of Artificial Sequence: Synthetic peptide
ARYDYAWYFDV

SEQ ID NO: 14 - protein, 11 aa, Artificial Sequence
  Description of Artificial Sequence: Synthetic peptide
QSIVHSNGNTY

SEQ ID NO: 15 - protein, 3 aa, Artificial Sequence
  Description of Artificial Sequence: Synthetic peptide
KVS

SEQ ID NO: 16 - protein, 9 aa, Artificial Sequence
  Description of Artificial Sequence: Synthetic peptide
FQGSHVPYT

SEQ ID NO: 17 - protein, 8 aa, Artificial Sequence
  Description of Artificial Sequence: Synthetic peptide
GYTFTSYW

SEQ ID NO: 18 - protein, 8 aa, Artificial Sequence
  Description of Artificial Sequence: Synthetic peptide
INPSNGGT

SEQ ID NO: 19 - protein, 12 aa, Artificial Sequence
  Description of Artificial Sequence: Synthetic peptide
ARRGIRLRHFDY

SEQ ID NO: 20 - protein, 6 aa, Artificial Sequence
  Description of Artificial Sequence: Synthetic peptide
QDVGTA

SEQ ID NO: 21 - protein, 3 aa, Artificial Sequence
  Description of Artificial Sequence: Synthetic peptide
WAS

SEQ ID NO: 22 - protein, 9 aa, Artificial Sequence
  Description of Artificial Sequence: Synthetic peptide
QQYSSYPLT

SEQ ID NO: 23 - protein, 8 aa, Artificial Sequence
  Description of Artificial Sequence: Synthetic peptide
GYTFTAYY

SEQ ID NO: 24 - protein, 8 aa, Artificial Sequence
  Description of Artificial Sequence: Synthetic peptide
INPYNGGT

SEQ ID NO: 25 - protein, 4 aa, Artificial Sequence
  Description of Artificial Sequence: Synthetic peptide
SSPY

SEQ ID NO: 26 - protein, 11 aa, Artificial Sequence
  Description of Artificial Sequence: Synthetic peptide
QSLLDSDGKTY

SEQ ID NO: 27 - protein, 3 aa, Artificial Sequence
  Description of Artificial Sequence: Synthetic peptide
LVS

SEQ ID NO: 28 - protein, 9 aa, Artificial Sequence
  Description of Artificial Sequence: Synthetic peptide
WQGTHFPRT

SEQ ID NO: 29 - protein, 8 aa, Artificial Sequence
  Description of Artificial Sequence: Synthetic peptide
GYTFTNYY

SEQ ID NO: 30 - protein, 8 aa, Artificial Sequence
  Description of Artificial Sequence: Synthetic peptide
INPYNGGT

SEQ ID NO: 31 - protein, 4 aa, Artificial Sequence
  Description of Artificial Sequence: Synthetic peptide
SSPY

SEQ ID NO: 32 - protein, 11 aa, Artificial Sequence
  Description of Artificial Sequence: Synthetic peptide
QSLLDSDGKTY

SEQ ID NO: 33 - protein, 3 aa, Artificial Sequence
  Description of Artificial Sequence: Synthetic peptide
LVS

SEQ ID NO: 34 - protein, 9 aa, Artificial Sequence
  Description of Artificial Sequence: Synthetic peptide
WQGTHFPRT

SEQ ID NO: 35 - protein, 8 aa, Artificial Sequence
  Description of Artificial Sequence: Synthetic peptide
GYTFTDYY

SEQ ID NO: 36 - protein, 8 aa, Artificial Sequence
  Description of Artificial Sequence: Synthetic peptide
INPYNGGT

SEQ ID NO: 37 - protein, 6 aa, Artificial Sequence
  Description of Artificial Sequence: Synthetic peptide
SRGGPY

SEQ ID NO: 38 - protein, 11 aa, Artificial Sequence
  Description of Artificial Sequence: Synthetic peptide
QSLLDSDGKTY

SEQ ID NO: 39 - protein, 3 aa, Artificial Sequence
  Description of Artificial Sequence: Synthetic peptide
LVS

SEQ ID NO: 40 - protein, 9 aa, Artificial Sequence
  Description of Artificial Sequence: Synthetic peptide
WQGTHFPRT

SEQ ID NO: 41 - protein, 646 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 42 - protein, 1096 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNK

SEQ ID NO: 43 - protein, 897 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSGGGGSGGGGSGGGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 44 - protein, 570 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSGGGGSGGGGSGGGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSI

SEQ ID NO: 45 - protein, 214 aa, Artificial Sequence
  Description of Artificial Sequence: Synthetic polypeptide
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 46 - protein, 551 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSI

SEQ ID NO: 47 - protein, 878 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 48 - protein, 1328 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNK

SEQ ID NO: 49 - protein, 878 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSQVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCG

SEQ ID NO: 50 - protein, 1328 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKGGGGSGGGGSQVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCG

SEQ ID NO: 51 - protein, 442 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 52 - protein, 1098 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 53 - protein, 1098 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 54 - protein, 442 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPG

SEQ ID NO: 55 - protein, 877 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPG

SEQ ID NO: 56 - protein, 1098 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSQVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPG

SEQ ID NO: 57 - protein, 870 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 58 - protein, 216 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCG

SEQ ID NO: 59 - protein, 219 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLESGVPDRFTGSGSGTDFTLEISRVEAEDLGVYYCWQGTHFPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 60 - protein, 545 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSI

SEQ ID NO: 61 - protein, 872 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 62 - protein, 436 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 63 - protein, 1092 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 64 - protein, 436 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPG

SEQ ID NO: 65 - protein, 1092 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 66 - protein, 1092 aa, Artificial Sequence; identical to SEQ ID NO: 63
  Description of Artificial Sequence: Synthetic polypeptide

SEQ ID NO: 67 - protein, 214 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCG

SEQ ID NO: 68 - protein, 219 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 69 - protein, 543 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSI

SEQ ID NO: 70 - protein, 870 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 71 - protein, 529 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLK

SEQ ID NO: 72 - protein, 305 aa, Homo sapiens
EDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLK

SEQ ID NO: 73 - protein, 434 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 74 - protein, 434 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPG

SEQ ID NO: 75 - protein, 1090 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 76 - protein, 1090 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 77 - protein, 875 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 78 - protein, 1090 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSEVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 79 - protein, 875 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 80 - protein, 877 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPG

SEQ ID NO: 81 - protein, 434 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPG

SEQ ID NO: 82 - protein, 749 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLK

SEQ ID NO: 83 - protein, 749 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLK

SEQ ID NO: 84 - protein, 534 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLK

SEQ ID NO: 85 - protein, 749 aa, Artificial Sequence
  Description of Artificial Sequence: Synthetic polypeptide
EDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKGGGGSGGGGSEVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 86 - protein, 534 aa, Artificial Sequence
  Description of Artificial Sequence: Synthetic polypeptide
EDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 87 - protein, 536 aa, Artificial Sequence
  Description of Artificial Sequence: Synthetic polypeptide
EDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKGGGGSGGGGSGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPG

SEQ ID NO: 88 - protein, 434 aa, Artificial Sequence; identical to SEQ ID NO: 81
  Description of Artificial Sequence: Synthetic polypeptide

SEQ ID NO: 89 - protein, 434 aa, Artificial Sequence; identical to SEQ ID NO: 81
  Description of Artificial Sequence: Synthetic polypeptide

SEQ ID NO: 90 - protein, 877 aa, Artificial Sequence; identical to SEQ ID NO: 80
  Description of Artificial Sequence: Synthetic polypeptide

SEQ ID NO: 91 - protein, 659 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 92 - protein, 1109 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKENLYFQGHHHHHH

SEQ ID NO: 93 - protein, 910 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSGGGGSGGGGSGGGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 94 - protein, 583 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSGGGGSGGGGSGGGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSIENLYFQGHHHHHH

SEQ ID NO: 95 - protein, 1098 aa, Artificial Sequence; identical to SEQ ID NO: 52
  Description of Artificial Sequence: Synthetic polypeptide

SEQ ID NO: 96 - protein, 1098 aa, Artificial Sequence; identical to SEQ ID NO: 52
  Description of Artificial Sequence: Synthetic polypeptide

SEQ ID NO: 97 - protein, 1098 aa, Artificial Sequence; identical to SEQ ID NO: 53
  Description of Artificial Sequence: Synthetic polypeptide

SEQ ID NO: 98 - protein, 442 aa, Artificial Sequence; identical to SEQ ID NO: 51
  Description of Artificial Sequence: Synthetic polypeptide

SEQ ID NO: 99 - protein, 442 aa, Artificial Sequence; identical to SEQ ID NO: 54
  Description of Artificial Sequence: Synthetic polypeptide

SEQ ID NO: 100 - protein, 551 aa, Artificial Sequence; identical to SEQ ID NO: 46
  Description of Artificial Sequence: Synthetic polypeptide

SEQ ID NO: 101 - protein, 878 aa, Artificial Sequence; identical to SEQ ID NO: 47
  Description of Artificial Sequence: Synthetic polypeptide

SEQ ID NO: 102 - protein, 1328 aa, Artificial Sequence; identical to SEQ ID NO: 48
  Description of Artificial Sequence: Synthetic polypeptide

SEQ ID NO: 103 - protein, 877 aa, Artificial Sequence; identical to SEQ ID NO: 55
  Description of Artificial Sequence: Synthetic polypeptide

SEQ ID NO: 104 - protein, 1098 aa, Artificial Sequence; identical to SEQ ID NO: 56
  Description of Artificial Sequence: Synthetic polypeptide

SEQ ID NO: 105 - protein, 878 aa, Artificial Sequence; identical to SEQ ID NO: 49
  Description of Artificial Sequence: Synthetic polypeptide

SEQ ID NO: 106 - protein, 1328 aa, Artificial Sequence; identical to SEQ ID NO: 50
  Description of Artificial Sequence: Synthetic polypeptide

SEQ ID NO: 107 - protein, 870 aa, Artificial Sequence; identical to SEQ ID NO: 57
  Description of Artificial Sequence: Synthetic polypeptide

SEQ ID NO: 108 - protein, 318 aa, Artificial Sequence
  Description of Artificial Sequence: Synthetic polypeptide
EDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 109 - protein, 558 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSIENLYFQGHHHHHH

SEQ ID NO: 110 - protein, 885 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 111 - protein, 544 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 112 - protein, 436 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPG

SEQ ID NO: 113 - protein, 764 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 114 - protein, 764 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 115 - protein, 556 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSCPAPSQLPSAKPINLTDESMFPIGTYLLYECLPGYIKRQFSITCKQDSTWTSAEDKCIRKQCKTPSDPENGLVHVHTGIQFGSRINYTCNQGYRLIGSSSAVCVITDQSVDWDTEAPICEWIPCEIPPGIPNGDFFSSTREDFHYGMVVTYRCNTDARGKALFNLVGEPSLYCTSNDGEIGVWSGPPPQCIELNKCTPPPYVENAVMLSENRSLFSLRDIVEFRCHPGFIMKGASSVHCQSLNKWEPELPSCFKGVICRLPQEMSGFQKGLGMKKEYYYGENVTLECEDGYTLEGSSQSQCQSDGSWNPLLAKCVSRSIENLYFQGHHHHHH

SEQ ID NO: 116 - protein, 883 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 117 - protein, 542 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 118 - protein, 888 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 119 - protein, 1103 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 120 - protein, 1103 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKENLYFQGHHHHHH

SEQ ID NO: 121 - protein, 762 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 122 - protein, 762 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 123 - protein, 1103 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSEVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGENLYFQGHHHHHH

SEQ ID NO: 124 - protein, 888 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECENLYFQGHHHHHH

SEQ ID NO: 125 - protein, 1092 aa, Artificial Sequence; identical to SEQ ID NO: 63
  Description of Artificial Sequence: Synthetic polypeptide

SEQ ID NO: 126 - protein, 1098 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKHHHHHH

SEQ ID NO: 127 - protein, 1098 aa, Artificial Sequence
  Description of Artificial Sequence: Synthetic polypeptide
EVQLQQSGPVLVKPGASVKMSCKASGYTFTDYYMNWVKQSHGKSLEWIGVINPYNGGTSYNQKFKGKATLTVDKSSRTAYMELNSLTSEDSAVYYCSRGGPYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKHHHHHH

SEQ ID NO: 128 - protein, 547 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECGGGGSGGGGSEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKENLYFQGHHHHHH

SEQ ID NO: 129 - protein, 547 aa, Artificial Sequence
  Description of Artificial Sequence: Synthetic polypeptide
EDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECENLYFQGHHHHHH

SEQ ID NO: 130 - protein, 877 aa, Artificial Sequence; identical to SEQ ID NO: 80
  Description of Artificial Sequence: Synthetic polypeptide

SEQ ID NO: 131 - protein, 536 aa, Artificial Sequence; identical to SEQ ID NO: 87
  Description of Artificial Sequence: Synthetic polypeptide

SEQ ID NO: 132 - protein, 1333 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKENLYFQGHHHHHH

SEQ ID NO: 133 - protein, 1553 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKENLYFQGHHHHHH

SEQ ID NO: 134 - protein, 1553 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKENLYFQGHHHHHH

SEQ ID NO: 135 - protein, 1338 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKENLYFQGHHHHHH

SEQ ID NO: 136 - protein, 1553 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKGGGGSGGGGSEVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGENLYFQGHHHHHH

SEQ ID NO: 137 - protein, 1338 aa, Artificial Sequence
  Description of Artificial Sequence: Synthetic polypeptide
QCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPRTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNECENLYFQGHHHHHH

SEQ ID NO: 138 - protein, 10 aa, Artificial Sequence
  Description of Artificial Sequence: Synthetic peptide
GGGGSGGGGS

SEQ ID NO: 139 - protein, 749 aa, Artificial Sequence; identical to SEQ ID NO: 82
  Description of Artificial Sequence: Synthetic polypeptide

SEQ ID NO: 140 - protein, 1090 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPGGGGGSGGGGSQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNK

SEQ ID NO: 141 - protein, 695 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRG

SEQ ID NO: 142 - protein, 521 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSLQCYNCPNPTADCKTAVNCSSDFDACLITKAGLQVYNKCWKFEHCNFNDVTTRLRENELTYYCCKKDLCNFNEQLEN

SEQ ID NO: 143 - protein, 805 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 144 - protein, 695 aa, Artificial Sequence
  Description of Artificial Sequence: Synthetic polypeptide
EVQLQQSGPVLVKPGASVKMSCKASGYTFTNYYINWVKQSHGKSLEWIGVINPYNGGTSYNQKFKGKATLTVDKSSSTAYMELNSLTSEDSAVYFCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGGGGGSGGGGSCEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLK

SEQ ID NO: 145 - protein, 113 aa, Artificial Sequence
  Description of Artificial Sequence: Synthetic polypeptide
QAYLQQSGAELVRPGASVKMSCKASGYTFTSYYMHWVKQTPRQGLEWIGAIYPGNGDTSYNQKFKGKATLTVDKSSSTAYMQLSSLTSEDSAVYFCAKGFDYWGQGTTVTVSS

SEQ ID NO: 146 - protein, 113 aa, Artificial Sequence
  Description of Artificial Sequence: Synthetic polypeptide
DVVMTQTPLSLPVSLGDQASISCRSSQSLVYSNGNTYLHWYLQKPGQSPKLLIYKVSNRFSGVPDRFSGSGSGTDFTLKISRVEAEDLGVYFCSQSTHVPYTFGGGTKLEIKR

SEQ ID NO: 147 - protein, 8 aa, Artificial Sequence
  Description of Artificial Sequence: Synthetic peptide
GYTFTSYY

SEQ ID NO: 148 - protein, 8 aa, Artificial Sequence
  Description of Artificial Sequence: Synthetic peptide
IYPGNGDT

SEQ ID NO: 149 - protein, 6 aa, Artificial Sequence
  Description of Artificial Sequence: Synthetic peptide
AKGFDY

SEQ ID NO: 150 - protein, 11 aa, Artificial Sequence
  Description of Artificial Sequence: Synthetic peptide
QSLVYSNGNTY

SEQ ID NO: 151 - protein, 3 aa, Artificial Sequence
  Description of Artificial Sequence: Synthetic peptide
KVS

SEQ ID NO: 152 - protein, 9 aa, Artificial Sequence
  Description of Artificial Sequence: Synthetic peptide
SQSTHVPYT

SEQ ID NO: 153 - protein, 114 aa, Artificial Sequence
  Description of Artificial Sequence: Synthetic polypeptide
QAYLQQSGAELVRPGASVKMSCKASGYTFTSYYMHWVKQTPRQGLEWIGAIYPGNGDTSYNQKFKGKATLTVDKSSSTAYMQLSSLTSEDSAVYFCAKYGSGYWGQGTTVTVSS

SEQ ID NO: 154 - protein, 113 aa, Artificial Sequence; identical to SEQ ID NO: 146
  Description of Artificial Sequence: Synthetic polypeptide

SEQ ID NO: 155 - protein, 8 aa, Artificial Sequence
  Description of Artificial Sequence: Synthetic peptide
GYTFTSYY

SEQ ID NO: 156 - protein, 8 aa, Artificial Sequence
  Description of Artificial Sequence: Synthetic peptide
IYPGNGDT

SEQ ID NO: 157 - protein, 7 aa, Artificial Sequence
  Description of Artificial Sequence: Synthetic peptide
AKYGSGY

SEQ ID NO: 158 - protein, 11 aa, Artificial Sequence
  Description of Artificial Sequence: Synthetic peptide
QSLVYSNGNTY

SEQ ID NO: 159 - protein, 3 aa, Artificial Sequence
  Description of Artificial Sequence: Synthetic peptide
KVS

SEQ ID NO: 160 - protein, 9 aa, Artificial Sequence
  Description of Artificial Sequence: Synthetic peptide
SQSTHVPYT

SEQ ID NO: 161 - protein, 17 aa, Artificial Sequence
  Description of Artificial Sequence: Synthetic peptide
  MISC_FEATURE (1)..(17): This sequence may encompass 0-17 residues
  See specification as filed for detailed description of substitutions and preferred embodiments
GGGGGGGGGGGGGGGGG

SEQ ID NO: 162 - protein, 18 aa, Artificial Sequence
  Description of Artificial Sequence: Synthetic peptide
KESGSVSSEQLAQFRSLD

SEQ ID NO: 163 - protein, 14 aa, Artificial Sequence
  Description of Artificial Sequence: Synthetic peptide
EGKSSGSGSESKST

SEQ ID NO: 164 - protein, 85 aa, Artificial Sequence
  Description of Artificial Sequence: Synthetic polypeptide
  MISC_FEATURE (1)..(85): This sequence may encompass 0-17 'Gly Gly Gly Gly Ser' repeating units
  See specification as filed for detailed description of substitutions and preferred embodiments
GGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 165 - protein, 85 aa, Artificial Sequence
  Description of Artificial Sequence: Synthetic polypeptide
  MISC_FEATURE (1)..(85): This sequence may encompass 0-17 'Glu Ala Ala Ala Lys' repeating units
  See specification as filed for detailed description of substitutions and preferred embodiments
EAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 166 - protein, 87 aa, Artificial Sequence
  Description of Artificial Sequence: Synthetic polypeptide
  MISC_FEATURE (2)..(86): This region may encompass 0-17 'Glu Ala Ala Ala Lys' repeating units
  See specification as filed for detailed description of substitutions and preferred embodiments
AEAAAKEAAAKEAAAKEAAAKEAAAKEAAAKEAAAKEAAAKEAAAKEAAAKEAAAKEAAAKEAAAKEAAAKEAAAKEAAAKEAAAKA

SEQ ID NO: 167 - protein, 12 aa, Artificial Sequence
  Description of Artificial Sequence: Synthetic peptide
GSAGSAAGSGEF

SEQ ID NO: 168 - protein, 34 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MISC_FEATURE (1)..(34): This sequence may encompass 0-17 'Xaa Pro' repeating units
  See specification as filed for detailed description of substitutions and preferred embodiments
XPXPXPXPXPXPXPXPXPXPXPXPXPXPXPXPXP

SEQ ID NO: 169 - protein, 46 aa, Artificial Sequence
  Description of Artificial Sequence: Synthetic polypeptide
AEAAAKEAAAKEAAAKEAAAKALEAEAAAKEAAAKEAAAKEAAAKA

SEQ ID NO: 170 - protein, 51 aa, Artificial Sequence
  Description of Artificial Sequence: Synthetic polypeptide
  MISC_FEATURE (1)..(51): This sequence may encompass 0-17 'Pro Ala Ser' repeating units
  See specification as filed for detailed description of substitutions and preferred embodiments
PASPASPASPASPASPASPASPASPASPASPASPASPASPASPASPASPAS

SEQ ID NO: 171 - protein, 34 aa, Artificial Sequence
  Description of Artificial Sequence: Synthetic polypeptide
  MISC_FEATURE (1)..(34): This sequence may encompass 0-17 'Gly Ser' repeating units
  See specification as filed for detailed description of substitutions and preferred embodiments
GSGSGSGSGSGSGSGSGSGSGSGSGSGSGSGSGS

SEQ ID NO: 172 - protein, 16 aa, Artificial Sequence
  Description of Artificial Sequence: Synthetic peptide
GGGGSLVPRGSGGGGS

SEQ ID NO: 173 - protein, 11 aa, Artificial Sequence
  Description of Artificial Sequence: Synthetic peptide
GGSGGHMGSGG

SEQ ID NO: 174 - protein, 51 aa, Artificial Sequence
  Description of Artificial Sequence: Synthetic polypeptide
  MISC_FEATURE (1)..(51): This sequence may encompass 0-17 'Gly Gly Ser' repeating units
  See specification as filed for detailed description of substitutions and preferred embodiments
GGSGGSGGSGGSGGSGGSGGSGGSGGSGGSGGSGGSGGSGGSGGSGGSGGS

SEQ ID NO: 175 - protein, 8 aa, Artificial Sequence
  Description of Artificial Sequence: Synthetic peptide
GGSGGGGG

SEQ ID NO: 176 - protein, 15 aa, Artificial Sequence
  Description of Artificial Sequence: Synthetic peptide
GGGSEGGGSEGGGSE

SEQ ID NO: 177 - protein, 8 aa, Artificial Sequence
  Description of Artificial Sequence: Synthetic peptide
AAGAATAA

SEQ ID NO: 178 - protein, 5 aa, Artificial Sequence
  Description of Artificial Sequence: Synthetic peptide
GGSSG

SEQ ID NO: 179 - protein, 34 aa, Artificial Sequence
  Description of Artificial Sequence: Synthetic polypeptide
  MISC_FEATURE (1)..(34): This sequence may encompass 0-17 'Gly Thr' repeating units
  See specification as filed for detailed description of substitutions and preferred embodiments
GTGTGTGTGTGTGTGTGTGTGTGTGTGTGTGTGT

SEQ ID NO: 180 - protein, 5 aa, Artificial Sequence
  Description of Artificial Sequence: Synthetic peptide
GSSSG

SEQ ID NO: 181 - protein, 11 aa, Artificial Sequence
  Description of Artificial Sequence: Synthetic peptide
GSGGGTGGGSG

SEQ ID NO: 182 - protein, 14 aa, Artificial Sequence
  Description of Artificial Sequence: Synthetic peptide
GSGGSGGSGGSGGS

SEQ ID NO: 183 - protein, 12 aa, Artificial Sequence
  Description of Artificial Sequence: Synthetic peptide
GSGSGSGSGGSG

SEQ ID NO: 184 - protein, 251 aa, Homo sapiens
DCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRG

SEQ ID NO: 185 - protein, 77 aa, Homo sapiens
LQCYNCPNPTADCKTAVNCSSDFDACLITKAGLQVYNKCWKFEHCNFNDVTTRLRENELTYYCCKKDLCNFNEQLEN

SEQ ID NO: 186 - protein, 361 aa, Homo sapiens
HTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 187 - protein, 251 aa, Homo sapiens
CEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLK

SEQ ID NO: 188 - protein, 8 aa, Artificial Sequence
  Description of Artificial Sequence: Synthetic peptide
GHSFTNYL

SEQ ID NO: 189 - protein, 8 aa, Artificial Sequence
  Description of Artificial Sequence: Synthetic peptide
INPGSGGT

SEQ ID NO: 190 - protein, 12 aa, Artificial Sequence
  Description of Artificial Sequence: Synthetic peptide
ASYYSNSYAMDY

SEQ ID NO: 191 - protein, 6 aa, Artificial Sequence
  Description of Artificial Sequence: Synthetic peptide
ENIYSY

SEQ ID NO: 192 - protein, 3 aa, Artificial Sequence
  Description of Artificial Sequence: Synthetic peptide
KAK

SEQ ID NO: 193 - protein, 9 aa, Artificial Sequence
  Description of Artificial Sequence: Synthetic peptide
QHHYGIPYT

SEQ ID NO: 194 - protein, 119 aa, Artificial Sequence
  Description of Artificial Sequence: Synthetic polypeptide
QVQLQQSGAELVRPGTSVKVSCKASGHSFTNYLIEWVKQRPGQGLEWIGVINPGSGGTNYNEKFKVKATLTADKSSSTAYMQLSSLTSEDSAVYFCASYYSNSYAMDYWGQGTSVTVSS

SEQ ID NO: 195 - protein, 107 aa, Artificial Sequence
  Description of Artificial Sequence: Synthetic polypeptide
DIQMTQSPASLSASVGETVTIACRASENIYSYLAWYLQKEGKSPQLLVSKAKTLADGVPSRFSGGGSGTQFSLKINSLQPEDFGTFYCQHHYGIPYTFGGGTKLEIK

SEQ ID NO: 196 - protein, 8 aa, Artificial Sequence
  Description of Artificial Sequence: Synthetic peptide
GYAFAHYL

SEQ ID NO: 197 - protein, 8 aa, Artificial Sequence
  Description of Artificial Sequence: Synthetic peptide
INPGTDGT

SEQ ID NO: 198 - protein, 9 aa, Artificial Sequence
  Description of Artificial Sequence: Synthetic peptide
AREELGFAY

SEQ ID NO: 199 - protein, 6 aa, Artificial Sequence
  Description of Artificial Sequence: Synthetic peptide
QDISNH

SEQ ID NO: 200 - protein, 3 aa, Artificial Sequence
  Description of Artificial Sequence: Synthetic peptide
YIS

SEQ ID NO: 201 - protein, 9 aa, Artificial Sequence
  Description of Artificial Sequence: Synthetic peptide
QQGDTLPYT

SEQ ID NO: 202 - protein, 116 aa, Artificial Sequence
  Description of Artificial Sequence: Synthetic polypeptide
QVQLQQSGAELVRPGTSVKVSCKASGYAFAHYLIEWVKQRPGQGLEWIGVINPGTDGTNYNEKFKGKATLTADKSSSTAYMHLSSLTSEDSAVYFCAREELGFAYWGQGTLVTVSA

SEQ ID NO: 203 - protein, 107 aa, Artificial Sequence
  Description of Artificial Sequence: Synthetic polypeptide
DIQMTQSTSSLSASLGDRVTISCRASQDISNHLNWYQQRPDGTVKLLIYYISRLHSGVPSRFSGSGSGTDYSLTISNLEQEDIATYFCQQGDTLPYTFGGGTTLEIR

SEQ ID NO: 204 - protein, 7 aa, Artificial Sequence
  Description of Artificial Sequence: Synthetic peptide
GYTFTSY

SEQ ID NO: 205 - protein, 8 aa, Artificial Sequence
  Description of Artificial Sequence: Synthetic peptide
SDPSDTYT

SEQ ID NO: 206 - protein, 12 aa, Artificial Sequence
  Description of Artificial Sequence: Synthetic peptide
ARPGRVAYYFDY

SEQ ID NO: 207 - protein, 11 aa, Artificial Sequence
  Description of Artificial Sequence: Synthetic peptide
QSLVHSNGNTY

SEQ ID NO: 208 - protein, 3 aa, Artificial Sequence
  Description of Artificial Sequence: Synthetic peptide
KVS

SEQ ID NO: 209 - protein, 9 aa, Artificial Sequence
  Description of Artificial Sequence: Synthetic peptide
FQGSHVPPT

SEQ ID NO: 210 - protein, 119 aa, Artificial Sequence
  Description of Artificial Sequence: Synthetic polypeptide
QVQLQQPGAELVRPGTSVKLSCKASGYTFTSYWMHWVKQRPGQGLEWIGVSDPSDTYTKNNQKFTGKATLTVDTSSSTAYMQLSSLTSEDSAVYYCARPGRVAYYFDYWGQGTTLTVSS

SEQ ID NO: 211 - protein, 112 aa, Artificial Sequence
  Description of Artificial Sequence: Synthetic polypeptide
DVLMTQTPLSLPVSLGDQASISCRSSQSLVHSNGNTYLEWYLQKPGQSPKLLIYKVSNRFSGVPDRFSGSGSGTDFTLKISRVEAEDLGVYYCFQGSHVPPTFGGGTKLEIK

SEQ ID NO: 212 - protein, 8 aa, Artificial Sequence
  Description of Artificial Sequence: Synthetic peptide
GYAFTNYL

SEQ ID NO: 213 - protein, 8 aa, Artificial Sequence
  Description of Artificial Sequence: Synthetic peptide
INPGSGGT

SEQ ID NO: 214 - protein, 12 aa, Artificial Sequence
  Description of Artificial Sequence: Synthetic peptide
ATYYSNSFAMDY

SEQ ID NO: 215 - protein, 12 aa, Artificial Sequence
  Description of Artificial Sequence: Synthetic peptide
QSLLNSSNQKNY

SEQ ID NO: 216 - protein, 3 aa, Artificial Sequence
  Description of Artificial Sequence: Synthetic peptide
FAS

SEQ ID NO: 217 - protein, 9 aa, Artificial Sequence
  Description of Artificial Sequence: Synthetic peptide
QQYYSIPFT

SEQ ID NO: 218 - protein, 119 aa, Artificial Sequence
  Description of Artificial Sequence: Synthetic polypeptide
QVQLQQSGAELVRPGTSVKVSCKASGYAFTNYLIEWIKQRPGQGLEWIGVINPGSGGTNYNEKFKGKATLTADKSSNTAYMHLSSLTSEDSAVYFCATYYSNSFAMDYWGQGTSVTVSS

SEQ ID NO: 219 - protein, 113 aa, Artificial Sequence
  Description of Artificial Sequence: Synthetic polypeptide
DIVMTQSPSSLAMSVGQKVTMSCKSSQSLLNSSNQKNYLAWYQQKPGQCPKVLVYFASTRESGVPDRFIGSGSGTDFTLTISSVQAEDLADYFCQQYYSIPFTFGSGTKLEIK

SEQ ID NO: 220 - protein, 8 aa, Artificial Sequence
  Description of Artificial Sequence: Synthetic peptide
GYAFAHYL

SEQ ID NO: 221 - protein, 8 aa, Artificial Sequence
  Description of Artificial Sequence: Synthetic peptide
INPGTDGT

SEQ ID NO: 222 - protein, 9 aa, Artificial Sequence
  Description of Artificial Sequence: Synthetic peptide
AREELGFAY

SEQ ID NO: 223 - protein, 6 aa, Artificial Sequence
  Description of Artificial Sequence: Synthetic peptide
QDISNH

SEQ ID NO: 224 - protein, 3 aa, Artificial Sequence
  Description of Artificial Sequence: Synthetic peptide
YIS

SEQ ID NO: 225 - protein, 9 aa, Artificial Sequence
  Description of Artificial Sequence: Synthetic peptide
QQGDTLPYT

SEQ ID NO: 226 - protein, 116 aa, Artificial Sequence; identical to SEQ ID NO: 202
  Description of Artificial Sequence: Synthetic polypeptide

SEQ ID NO: 227 - protein, 107 aa, Artificial Sequence; identical to SEQ ID NO: 203
  Description of Artificial Sequence: Synthetic polypeptide

SEQ ID NO: 228 - protein, 8 aa, Artificial Sequence
  Description of Artificial Sequence: Synthetic peptide
GYSFTDYN

SEQ ID NO: 229 - protein, 8 aa, Artificial Sequence
  Description of Artificial Sequence: Synthetic peptide
INPNYGTT

SEQ ID NO: 230 - protein, 5 aa, Artificial Sequence
  Description of Artificial Sequence: Synthetic peptide
ARNDY

SEQ ID NO: 231 - protein, 11 aa, Artificial Sequence
  Description of Artificial Sequence: Synthetic peptide
QSIVHSNGNTY

SEQ ID NO: 232 - protein, 3 aa, Artificial Sequence
  Description of Artificial Sequence: Synthetic peptide
KVS

SEQ ID NO: 233 - protein, 9 aa, Artificial Sequence
  Description of Artificial Sequence: Synthetic peptide
FQGSHVPFT

SEQ ID NO: 234 - protein, 112 aa, Artificial Sequence
  Description of Artificial Sequence: Synthetic polypeptide
EFQLQQSGPELVKPGASVKLSCKASGYSFTDYNMNWVKQSNGKSLEWIGVINPNYGTTFYNQKFKGKATLTVDQSSSTAYMQLNSLTSEDSAVYYCARNDYWGRGTTLTVSS

SEQ ID NO: 235 - protein, 112 aa, Artificial Sequence
  Description of Artificial Sequence: Synthetic polypeptide
DVLMTQTPLSLPVSLGDQASISCRSSQSIVHSNGNTYLDWYLQRPGQSPKLLIYKVSNRFSGVPDRFSGSGSGTDFTLKISRVEAEDLGIYYCFQGSHVPFTFGSGTKLEIK

SEQ ID NO: 236 - protein, 226 aa, Artificial Sequence
  Description of Artificial Sequence: Synthetic polypeptide
VPRDSGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 237 - protein, 228 aa, Artificial Sequence
  Description of Artificial Sequence: Synthetic polypeptide
ESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 238 - protein, 442 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLSCAITDFFPEDITVEWQWNGQPAENYKNTQPIMDTDGSYFVVSKLNVQKSNWEAGNTFTCSVLHEGLHNHHTEKSLSHSPG

SEQ ID NO: 239 - protein, 241 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSGGGGSGGGGSGGGGSDIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELK

SEQ ID NO: 240 - protein, 222 aa, Artificial Sequence
  Description of Artificial Sequence: Synthetic polypeptide
QVQLQQPGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCG

SEQ ID NO: 241 - protein, 15 aa, Artificial Sequence
  Description of Artificial Sequence: Synthetic peptide
GGGGSGGGGSGGGGS

SEQ ID NO: 242 - protein, 10 aa, Artificial Sequence
  Description of Artificial Sequence: Synthetic peptide
GGGGSGGGGS

SEQ ID NO: 243 - protein, 436 aa, Artificial Sequence; identical to SEQ ID NO: 112
  Description of Artificial Sequence: Synthetic polypeptide

SEQ ID NO: 244 - protein, 216 aa, Artificial Sequence; identical to SEQ ID NO: 58
  Description of Artificial Sequence: Synthetic polypeptide

SEQ ID NO: 245 - protein, 220 aa, Artificial Sequence
  Description of Artificial Sequence: Synthetic polypeptide
CKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLWCMITDFFPEDITVEWQWNGQPAENYKNTQPIMDTDGSYFVYSKLNVQKSNWEAGNTFTCSVLHEGLHNHHTEKSLSHSPG

SEQ ID NO: 246 - protein, 111 aa, Artificial Sequence
  Description of Artificial Sequence: Synthetic polypeptide
EVQLVQSGPVVVKPGASVKMSCKASGYTFTNYYINWVKQAHGQGLEWIGVINPYNGGTSYNQKFKGRATLTVDKSSSTAYMELSSLRSEDTAVYFCSSPYWGQGTLVTVSS

SEQ ID NO: 247 - protein, 111 aa, Artificial Sequence
  Description of Artificial Sequence: Synthetic polypeptide
EVQLVQSGAVVKKPGASVKMSCKASGYTFTNYYINWVKQAPGQGLEWIGVINPYNGGTSYNQKFKGRATLTVDKSSSTAYMELSSLRSEDTAVYFCSSPYWGQGTLVTVSS

SEQ ID NO: 248 - protein, 111 aa, Artificial Sequence
  Description of Artificial Sequence: Synthetic polypeptide
EVQLVQSGAEVKKPGASVKVSCKASGYTFTNYYINWVRQAPGQGLEWIGVINPYNGGTSYNQKFKGRATLTVDKSSSTAYMELSSLRSEDTAVYFCSSPYWGQGTLVTVSS

SEQ ID NO: 249 - protein, 111 aa, Artificial Sequence
  Description of Artificial Sequence: Synthetic polypeptide
QVQLVQSGAEVKKPGASVKVSCKASGYTFTNYYINWVRQAPGQGLEWIGVINPYNGGTSYNQKFKGRATLTVDTSTSTAYMELSSLRSEDTAVYFCSSPYWGQGTLVTVSS

SEQ ID NO: 250 - protein, 111 aa, Artificial Sequence
  Description of Artificial Sequence: Synthetic polypeptide
QVQLVQSGAEVKKPGASVKVSCKASGYTFTNYYINWVRQAPGQGLEWIGVINPYHGGTSYNQKFKGRATLTVDTSTSTAYMELSSLRSEDTAVYFCSSPYWGQGTLVTVSS

SEQ ID NO: 251 - protein, 111 aa, Artificial Sequence
  Description of Artificial Sequence: Synthetic polypeptide
QVQLVQSGAEVKKPGASVKVSCKASGYTFTNYYINWVRQAPGQGLEWIGVINPYSGGTSYNQKFKGRATLTVDTSTSTAYMELSSLRSEDTAVYFCSSPYWGQGTLVTVSS

SEQ ID NO: 252 - protein, 111 aa, Artificial Sequence
  Description of Artificial Sequence: Synthetic polypeptide
QVQLVQSGAEVKKPGASVKVSCKASGYTFTNYYINWVRQAPGQGLEWMGVINPYNGGTSYNQKFKGRVTMTVDTSTSTAYMELSSLRSEDTAVYFCSSPYWGQGTLVTVSS

SEQ ID NO: 253 - protein, 111 aa, Artificial Sequence
  Description of Artificial Sequence: Synthetic polypeptide
QVQLVQSGAEVKKPGASVKVSCKASGYTFTNYYINWVRQAPGQGLEWMGVINPYHGGTSYNQKFKGRVTMTVDTSTSTAYMELSSLRSEDTAVYFCSSPYWGQGTLVTVSS

SEQ ID NO: 254 - protein, 111 aa, Artificial Sequence
  Description of Artificial Sequence: Synthetic polypeptide
QVQLVQSGAEVKKPGASVKVSCKASGYTFTNYYINWVRQAPGQGLEWMGVINPYSGGTSYNQKFKGRVTMTVDTSTSTAYMELSSLRSEDTAVYFCSSPYWGQGTLVTVSS

SEQ ID NO: 255 - protein, 111 aa, Artificial Sequence
  Description of Artificial Sequence: Synthetic polypeptide
QVQLVQSGAEVKKPGASVKVSCKASGYTFTNYYINWVRQAPGQGLEWMGVINPYNGGTSYNQKFKGRVTMTRDTSTSTVYMELSSLRSEDTAVYFCSSPYWGQGTLVTVSS

SEQ ID NO: 256 - protein, 112 aa, Artificial Sequence
  Description of Artificial Sequence: Synthetic polypeptide
DVVMTQSPLSLPVTLGQPASISCKSSQSLLDSDGKTYLNWLLQRPGQSPKRLIYLVSKLDSGVPDRFSGSGSGTDFTLKISRVEAEDVGVYYCWQGTHFPRTFGGGTKLEIK

SEQ ID NO: 257 - protein, 112 aa, Artificial Sequence
  Description of Artificial Sequence: Synthetic polypeptide
DVVMTQSPLSLPVTLGQPASISCKSSQSLLDSDGKTYLNWLQQRPGQSPRRLIYLVSKLDSGVPDRFSGSGSGTDFTLKISRVEAEDVGVYYCWQGTHFPRTFGGGTKVEIK

SEQ ID NO: 258 - protein, 112 aa, Artificial Sequence
  Description of Artificial Sequence: Synthetic polypeptide
DVVMTQSPLSLPVTLGQPASISCKSSQSLLDSDGKTYLNWFQQRPGQSPRRLIYLVSKLDSGVPDRFSGSGSGTDFTLKISRVEAEDVGVYYCWQGTHFPRTFGGGTKVEIK

SEQ ID NO: 259 - protein, 8 aa, Artificial Sequence
  Description of Artificial Sequence: Synthetic peptide
INPYHGGT

SEQ ID NO: 260 - protein, 8 aa, Artificial Sequence
  Description of Artificial Sequence: Synthetic peptide
INPYSGGT

SEQ ID NO: 261 - protein, 119 aa, Artificial Sequence
  Description of Artificial Sequence: Synthetic polypeptide
QVQLQQPGTELKKPGASVKLSCKASGYTFTSYWMHWVKQRPGQGLEWIGNINPSNGGTNYNEKFKSRATLTVDKSTSTAYMELSSLRSEDSAVYYCARRGIRLRHFDYWGQGTTVTVSS

SEQ ID NO: 262 - protein, 119 aa, Artificial Sequence
  Description of Artificial Sequence: Synthetic polypeptide
QVQLVQSGAEVKKPGASVKLSCKASGYTFTSYWMHWVKQRPGQGLEWIGNINPSNGGTNYNEKFKSRATLTVDKSTSTAYMELSSLRSEDTAVYYCARRGIRLRHFDYWGQGTTVTVSS

SEQ ID NO: 263 - protein, 119 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFKSRATLTVDKSTSTAYMELSSLRSEDTAVYYCARRGIRLRHFDYWGQGTTVTVSS

SEQ ID NO: 264 - protein, 119 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFKSRVTMTVDKSTSTAYMELSSLRSEDTAVYYCARRGIRLRHFDYWGQGTTVTVSS

SEQ ID NO: 265 - protein, 119 aa, Artificial Sequence
  Description of Artificial Sequence: Synthetic polypeptide
QVQLVQSGAEVKKPGASVKVSCKASGYTFTSYWMHWVRQAPGQGLEWIGNINPSNGGTNYNEKFQGRVTMTVDKSTSTAYMELSSLRSEDTAVYYCARRGIRLRHFDYWGQGTTVTVSS

SEQ ID NO: 266 - protein, 107 aa, Artificial Sequence
  Description of Artificial Sequence: Synthetic polypeptide
DIVMTQSPSFLSASVGDRVTITCKASQDVGTAVAWYQQKPGKAPKLLIYWASTRHTGVPDRFTGSGSGTDFTLTISSLQSEDFADYFCQQYSSYPLTFGQGTKLEIK

SEQ ID NO: 267 - protein, 107 aa, Artificial Sequence
  Description of Artificial Sequence: Synthetic polypeptide
DIVMTQSPSFLSASVGDRVTITCKASQDVGTAVAWYQQKPGKAPKLLIYWASTRHTGVPDRFSGSGSGTDFTLTISSLQPEDFADYFCQQYSSYPLTFGQGTKLEIK

SEQ ID NO: 268 - protein, 107 aa, Artificial Sequence
  Description of Artificial Sequence: Synthetic polypeptide
DIQMTQSPSFLSASVGDRVTITCKASQDVGTAVAWYQQKPGKAPKLLIYWASTRHTGVPSRFSGSGSGTEFTLTISSLQPEDFADYFCQQYSSYPLTFGQGTKLEIK

SEQ ID NO: 269 - protein, 107 aa, Artificial Sequence
  Description of Artificial Sequence: Synthetic polypeptide
DIQLTQSPSFLSASVGDRVTITCKASQDVGTAVAWYQQKPGKAPKLLIYWASTRHTGVPSRFSGSGSGTEFTLTISSLQPEDFADYFCQQYSSYPLTFGQGTKLEIK

SEQ ID NO: 270 - protein, 118 aa, Artificial Sequence
  Description of Artificial Sequence: Synthetic polypeptide
EVQLQQSGPELKKPGASVKISCKASGYTFTDYYMNWVKQAHGQGLEWIGDINPNNGGTSYNQKFKGRATLTVDKSSSTAYMELRSLTSEDSAVYYCARYDYAWYFDVWGQGTTVTVSS

SEQ ID NO: 271 - protein, 118 aa, Artificial Sequence
  Description of Artificial Sequence: Synthetic polypeptide
EVQLVQSGAEVKKPGASVKISCKASGYTFTDYYMNWVKQAHGQGLEWIGDINPNNGGTSYNQKFKGRATLTVDKSSSTAYMELSSLRSEDTAVYYCARYDYAWYFDVWGQGTTVTVSS

SEQ ID NO: 272 - protein, 118 aa, Artificial Sequence
  Description of Artificial Sequence: Synthetic polypeptide
EVQLVQSGAEVKKPGASVKVSCKASGYTFTDYYMNWVRQAPGQGLEWIGDINPNNGGTSYNQKFKGRATLTVDKSSSTAYMELSSLRSEDTAVYYCARYDYAWYFDVWGQGTTVTVSS

SEQ ID NO: 273 - protein, 118 aa, Artificial Sequence
  Description of Artificial Sequence: Synthetic polypeptide
EVQLVQSGAEVKKPGASVKVSCKASGYTFTDYYMNWVRQAPGQGLEWIGDINPNNGGTSYNQKFKGRVTMTVDKSSSTAYMELSSLRSEDTAVYYCARYDYAWYFDVWGQGTTVTVSS

SEQ ID NO: 274 - protein, 118 aa, Artificial Sequence
  Description of Artificial Sequence: Synthetic polypeptide
EVQLVQSGAEVKKPGASVKVSCKASGYTFTDYYMNWVRQAPGQGLEWIGDINPNNGGTSYNQKFQGRVTMTVDKSSSTAYMELSSLRSEDTAVYYCARYDYAWYFDVWGQGTTVTVSS

SEQ ID NO: 275 - protein, 112 aa, Artificial Sequence
  Description of Artificial Sequence: Synthetic polypeptide
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGQGTKLEIK

SEQ ID NO: 276 - protein, 112 aa, Artificial Sequence
  Description of Artificial Sequence: Synthetic polypeptide
DVVMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPYTFGQGTKLEIK

SEQ ID NO: 277 - protein, 112 aa, Artificial Sequence
  Description of Artificial Sequence: Synthetic polypeptide
DVVMTQSPLSLPVTLGQPASISCRSSQSIVHSNGNTYLEWFQQRPGQSPRLLIYKVSNRFSGVPDRFSGSGSGTDFTLKISRVEAEDVGVYYCFQGSHVPYTFGQGTKLEIK

SEQ ID NO: 278 - protein, 112 aa, Artificial Sequence
  Description of Artificial Sequence: Synthetic polypeptide
DVVMTQSPLSLPVTLGQPASISCRSSQSIVHSNGNTYLEWYQQRPGQSPRRLIYKVSNRFSGVPDRFSGSGSGTDFTLKISRVEAEDVGVYYCFQGSHVPYTFGQGTKLEIK

SEQ ID NO: 279 - protein, 219 aa, Artificial Sequence
  Description of Artificial Sequence: Synthetic polypeptide
DVVMTQSPLSLPVTLGQPASISCKSSQSLLDSDGKTYLNWFQQRPGQSPRRLIYLVSKLDSGVPDRFSGSGSGTDFTLKISRVEAEDVGVYYCWQGTHFPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 437 aa, Artificial Sequence
  Description of Artificial Sequence: Synthetic polypeptide
QVQLVQSGAEVKKPGASVKVSCKASGYTFTNYYINWVRQAPGQGLEWMGVINPYNGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 281 - protein, 437 aa, Artificial Sequence
  Description of Artificial Sequence: Synthetic polypeptide
QVQLVQSGAEVKKPGASVKVSCKASGYTFTNYYINWVRQAPGQGLEWMGVINPYNGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLG

SEQ ID NO: 282 - protein, 437 aa, Artificial Sequence
  Description of Artificial Sequence: Synthetic polypeptide
QVQLVQSGAEVKKPGASVKVSCKASGYTFTNYYINWVRQAPGQGLEWMGVINPYSGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLG

SEQ ID NO: 283 - protein, 228 aa, Artificial Sequence
  Description of Artificial Sequence: Synthetic polypeptide
ESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLG

SEQ ID NO: 284 - protein, 214 aa, Artificial Sequence
  Description of Artificial Sequence: Synthetic polypeptide
QVQLVQSGAEVKKPGASVKVSCKASGYTFTNYYINWVRQAPGQGLEWMGVINPYSGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYG

SEQ ID NO: 285 - protein, 437 aa, Artificial Sequence
  Description of Artificial Sequence: Synthetic polypeptide
QVQLVQSGAEVKKPGASVKVSCKASGYTFTNYYINWVRQAPGQGLEWMGVINPYSGGTSYNQKFKGRVTMTVDTSTSTAYMELSSLRSEDTAVYFCSSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 286 - protein, 437 aa, Artificial Sequence
  Description of Artificial Sequence: Synthetic polypeptide
QHQLVQSGAEVKKPGASVKVSCKASGYTFHNYYINWVRQAPGQGLEWMGVINPYSGGTSYNQKFKGRVTMTVDHSTSTAYMELSSLRSEDTAVYFCSSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVLHEALHSHYTQKSLSLSLG

SEQ ID NO: 287 - protein, 219 aa, Artificial Sequence
  Description of Artificial Sequence: Synthetic polypeptide
DVVMTQTPLTLSVTIGQPASISCKSSQSLLDSDGKTYLNWLLQRPGQSPKRLIYLVSKVDSGVPDRFTGSGSGTDFTLKINRVEAEDLGVYYCWQGTHFPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 288 - protein, 434 aa, Artificial Sequence
  Description of Artificial Sequence: Synthetic polypeptide
EVQLQQSGPVLVKPGASVKMSCKASGYTFTAYYMNWVRQSHGKSLEWIGVINPYNGGTSYNQKFKGKATLTVDKSSSTAYMELNSLTSEDSAVYYCSSPYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 289 - protein, 219 aa, Artificial Sequence
  Description of Artificial Sequence: Synthetic polypeptide
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 290 - protein, 444 aa, Artificial Sequence
  Description of Artificial Sequence: Synthetic polypeptide
QVQLQQPGAELVRPGTSVKLSCKASGYTFTSSWMHWVKQRPGQGLEWIGVIDPSDSYTNYNQKFKGKATLTVDTSSSTAYMQLSSLTSEDSAVYYCARGGGSSYNRYFDVWGTGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPG

SEQ ID NO: 291 - protein, 305 aa, Mus musculus
EDCKGPPPRENSEILSGSWSEQLYPEGTQATYKCRPGYRTLGTIVKVCKNGKWVASNPSRICRKKPCGHPGDTPFGSFRLAVGSQFEFGAKVVYTCDDGYQLLGEIDYRECGADGWINDIPLCEVVKCLPVTELENGRIVSGAAETDQEYYFGQVVRFECNSGFKIEGHKEIHCSENGLWSNEKPRCVEILCTPPRVENGDGINVKPVYKENERYHYKCKHGYVPKERGDAVCTGSGWSSQPFCEEKRCSPPYILNGIYTPHRIIHRSDDEIRYECNYGFYPVTGSTVSKCTPTGWIPVPRCTLK

SEQ ID NO: 292 - protein, 16 aa, Artificial Sequence
  Description of Artificial Sequence: Synthetic peptide
  MISC_FEATURE (1)..(16): This sequence may encompass 0-8 'Gly Ser' repeating units
GSGSGSGSGSGSGSGS

SEQ ID NO: 293 - protein, 16 aa, Artificial Sequence
  Description of Artificial Sequence: Synthetic peptide
  MISC_FEATURE (1)..(16): This sequence may encompass 1-4 'Gly Gly Gly Ser' repeating units
GGGSGGGSGGGSGGGS

SEQ ID NO: 294 - protein, 16 aa, Artificial Sequence
  Description of Artificial Sequence: Synthetic peptide
  MISC_FEATURE (1)..(16): This sequence may encompass 1-4 'Gly Ser Ser Gly' repeating units
GSSGGSSGGSSGGSSG

SEQ ID NO: 295 - protein, 5 aa, Artificial Sequence
  Description of Artificial Sequence: Synthetic peptide
GGGGS

SEQ ID NO: 296 - protein, 6 aa, Artificial Sequence
  Description of Artificial Sequence: Synthetic 6xHis tag
HHHHHH

SEQ ID NO: 297 - protein, 7 aa, Artificial Sequence
  Description of Artificial Sequence: Synthetic peptide
GSGSGSG

SEQ ID NO: 298 - protein, 10 aa, Artificial Sequence
  Description of Artificial Sequence: Synthetic peptide
YPYDVPDYAG

SEQ ID NO: 299 - protein, 10 aa, Artificial Sequence
  Description of Artificial Sequence: Synthetic peptide
NLDVSLQLPS

SEQ ID NO: 300 - protein, 6 aa, Artificial Sequence
  Description of Artificial Sequence: Synthetic peptide
VPRDCG

SEQ ID NO: 301 - protein, 15 aa, Artificial Sequence
  Description of Artificial Sequence: Synthetic peptide
GSGSGSGRLGREGVQ

SEQ ID NO: 302 - protein, 15 aa, Artificial Sequence
  Description of Artificial Sequence: Synthetic peptide
GREGVQKEDIPPADL

SEQ ID NO: 303 - protein, 15 aa, Artificial Sequence
  Description of Artificial Sequence: Synthetic peptide
IPPADLSDQVPDTES

SEQ ID NO: 304 - protein, 15 aa, Artificial Sequence
  Description of Artificial Sequence: Synthetic peptide
VPDTESETRILLQGT

SEQ ID NO: 305 - protein, 15 aa, Artificial Sequence
  Description of Artificial Sequence: Synthetic peptide
ILLQGTPVAQMTEDA

SEQ ID NO: 306 - protein, 15 aa, Artificial Sequence
  Description of Artificial Sequence: Synthetic peptide
QMTEDAVDAERLKHL

SEQ ID NO: 307 - protein, 15 aa, Artificial Sequence
  Description of Artificial Sequence: Synthetic peptide
ERLKHLIVTPSGCGE

SEQ ID NO: 308 - protein, 15 aa, Artificial Sequence
  Description of Artificial Sequence: Synthetic peptide
PSGCGEQNMIGMTPT

SEQ ID NO: 309 - protein, 15 aa, Artificial Sequence
  Description of Artificial Sequence: Synthetic peptide
IGMTPTVIAVHYLDE

SEQ ID NO: 310 - protein, 15 aa, Artificial Sequence
  Description of Artificial Sequence: Synthetic peptide
VHYLDETEQWEKFGL

SEQ ID NO: 311 - protein, 15 aa, Artificial Sequence
  Description of Artificial Sequence: Synthetic peptide
WEKFGLEKRQGALEL

SEQ ID NO: 312 - protein, 15 aa, Artificial Sequence
  Description of Artificial Sequence: Synthetic peptide
QGALELIKKGYTQQL

SEQ ID NO: 313 - protein, 15 aa, Artificial Sequence
  Description of Artificial Sequence: Synthetic peptide
GYTQQLAFRQPSSAF

SEQ ID NO: 314 - protein, 15 aa, Artificial Sequence
  Description of Artificial Sequence: Synthetic peptide
QPSSAFAAFVKRAPS

SEQ ID NO: 315 - protein, 15 aa, Artificial Sequence
  Description of Artificial Sequence: Synthetic peptide
VKRAPSTWLTAYVVK

SEQ ID NO: 316 - protein, 15 aa, Artificial Sequence
  Description of Artificial Sequence: Synthetic peptide
TAYVVKVFSLAVNLI

SEQ ID NO: 317 - protein, 15 aa, Artificial Sequence
  Description of Artificial Sequence: Synthetic peptide
LAVNLIAIDSQVLCG

SEQ ID NO: 318 - protein, 15 aa, Artificial Sequence
  Description of Artificial Sequence: Synthetic peptide
SQVLCGAVKWLILEK

SEQ ID NO: 319 - protein, 15 aa, Artificial Sequence
  Description of Artificial Sequence: Synthetic peptide
WLILEKQKPDGVFQE

SEQ ID NO: 320 - protein, 15 aa, Artificial Sequence
  Description of Artificial Sequence: Synthetic peptide
DGVFQEDAPVIHQEM

SEQ ID NO: 321 - protein, 15 aa, Artificial Sequence
  Description of Artificial Sequence: Synthetic peptide
VIHQEMIGGLRNNNE

SEQ ID NO: 322 - protein, 15 aa, Artificial Sequence
  Description of Artificial Sequence: Synthetic peptide
LRNNNEKDMALTAFV

SEQ ID NO: 323 - protein, 15 aa, Artificial Sequence
  Description of Artificial Sequence: Synthetic peptide
ALTAFVLISLQEAKD

SEQ ID NO: 324 - protein, 15 aa, Artificial Sequence
  Description of Artificial Sequence: Synthetic peptide
LQEAKDICEEQVNSL

SEQ ID NO: 325 - protein, 15 aa, Artificial Sequence
  Description of Artificial Sequence: Synthetic peptide
EQVNSLPGSITKAGD

SEQ ID NO: 326 - protein, 15 aa, Artificial Sequence
  Description of Artificial Sequence: Synthetic peptide
ITKAGDFLEANYMNL

SEQ ID NO: 327 - protein, 15 aa, Artificial Sequence
  Description of Artificial Sequence: Synthetic peptide
ANYMNLQRSYTVAIA

SEQ ID NO: 328 - protein, 15 aa, Artificial Sequence
  Description of Artificial Sequence: Synthetic peptide
YTVAIAGYALAQMGR

SEQ ID NO: 329 - protein, 15 aa, Artificial Sequence
  Description of Artificial Sequence: Synthetic peptide
LAQMGRLKGPLLNKF

SEQ ID NO: 330 - protein, 15 aa, Artificial Sequence
  Description of Artificial Sequence: Synthetic peptide
PLLNKFLTTAKDKNR

SEQ ID NO: 331 - protein, 15 aa, Artificial Sequence
  Description of Artificial Sequence: Synthetic peptide
AKDKNRWEDPGKQLY

SEQ ID NO: 332 - protein, 15 aa, Artificial Sequence
  Description of Artificial Sequence: Synthetic peptide
PGKQLYNVEATSYAL

SEQ ID NO: 333 - protein, 15 aa, Artificial Sequence
  Description of Artificial Sequence: Synthetic peptide
ATSYALLALLQLKDF

SEQ ID NO: 334 - protein, 15 aa, Artificial Sequence
  Description of Artificial Sequence: Synthetic peptide
LQLKDFDFVPPVVRW

SEQ ID NO: 335 - protein, 15 aa, Artificial Sequence
  Description of Artificial Sequence: Synthetic peptide
PPVVRWLNEQRYYGG

SEQ ID NO: 336 - protein, 15 aa, Artificial Sequence
  Description of Artificial Sequence: Synthetic peptide
QRYYGGGYGSTQATF

SEQ ID NO: 337 - protein, 15 aa, Artificial Sequence
  Description of Artificial Sequence: Synthetic peptide
STQATFMVFQALAQY

SEQ ID NO: 338 - protein, 15 aa, Artificial Sequence
  Description of Artificial Sequence: Synthetic peptide
QALAQYQKDAPDHQE

SEQ ID NO: 339 - protein, 15 aa, Artificial Sequence
  Description of Artificial Sequence: Synthetic peptide
APDHQELNLDVSLQL

SEQ ID NO: 340 - protein, 15 aa, Artificial Sequence
  Description of Artificial Sequence: Synthetic peptide
DVSLQLPSRSSKITH

SEQ ID NO: 341 - protein, 15 aa, Artificial Sequence
  Description of Artificial Sequence: Synthetic peptide
IVTPSGSGEQNMIGM

SEQ ID NO: 342 - protein, 447 aa, Artificial Sequence
  Description of Artificial Sequence: Synthetic polypeptide
EVQLQQSGPVLVKPGASVKMSCKASGYTFTAYYMNWVRQSHGKSLEWIGVINPYNGGTSYNQKFKGKATLTVDKSSSTAYMELNSLTSEDSAVYYCSSPYWGQGTSVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVRISWFVNNVEVHTAQTQTHREDYNSTIRVVSALPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLDIKTSKWEKTDSFSCNVRHEGLKNYYLKKTISRSPGK

SEQ ID NO: 343 - protein, 8 aa, Artificial Sequence
  Description of Artificial Sequence: Synthetic peptide
GYTFTSYW

What is claimed is:

1. A fusion protein construct comprising:
   (1) an antibody or an antigen binding fragment thereof that specifically binds to complement protein 3d (c3d), wherein the antibody or antigen binding fragment thereof comprises:
      (a) a heavy chain comprising three heavy chain complementarity determining regions (CDR-H1, CDR-H2, CDR-H3), wherein the CDR-H1 comprises the amino acid sequence of SEQ ID NO: 29, the CDR-H2 comprises the amino acid sequence of SEQ ID NO: 260, and the CDR-H3 comprises the amino acid sequence of SEQ ID NO: 31, and,
      (b) a light chain comprising three light chain complementarity determining regions (CDR-L1, CDR-L2, CDR-L3), wherein the CDR-L1 comprises the amino acid sequence of SEQ ID NO: 32, the CDR-L2 comprises the amino acid sequence of SEQ ID NO: 33, and the CDR-L3 comprises the amino acid sequence of SEQ ID NO: 34, and
   (2) a complement modulator polypeptide, wherein the complement modulator polypeptide comprises CR1 or a biologically active fragment thereof.

2. The fusion protein construct of claim 1, wherein the light chain comprises a light chain variable region (LCVR) comprising the amino acid sequence of SEQ ID NO: 258.

3. The fusion protein construct of claim 2, wherein the light chain comprises the amino acid sequence of SEQ ID NO: 279.

4. The fusion protein construct of claim 1, wherein the heavy chain comprises a heavy chain variable region (HCVR) comprising the amino acid sequence of SEQ ID NO: 254.

5. The fusion protein construct of claim 4, wherein the heavy chain comprises the amino acid sequence of SEQ ID NO: 284.

6. The fusion protein construct of claim 5, wherein the heavy chain comprises the amino acid sequence of SEQ ID NO: 282.

7. The fusion protein construct of claim 5, wherein the heavy chain comprises the amino acid sequence of SEQ ID NO: 285.

8. The fusion protein construct of claim 1, wherein:
   (a) the light chain comprises a light chain variable region (LCVR) comprising the amino acid sequence of SEQ ID NO: 258; and,
   (b) the heavy chain comprises a heavy chain variable region (HCVR) comprising the amino acid sequence of SEQ ID NO: 254.

9. The fusion protein construct of claim 8, wherein the light chain comprises the amino acid sequence of SEQ ID NO: 279.

10. The fusion protein construct of claim 9, wherein the heavy chain comprises the amino acid sequence of SEQ ID NO: 284.

11. The fusion protein construct of claim 10, wherein the fusion protein further comprises a linker linking the antibody or antigen binding fragment thereof to the complement modulator polypeptide.

12. The fusion protein construct of claim 11, wherein the linker comprises the amino acid sequence selected from the group consisting of SEQ ID NO: 138, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, and SEQ ID NO: 241.

13. The fusion protein construct of claim 11, wherein the linker is bound to the C-terminus of the heavy chain and comprises the amino acid sequence of SEQ ID NO: 138.

14. The fusion protein construct of claim 1, wherein the complement modulator polypeptide comprises an amino acid sequence selected from the group consisting of: SEQ ID NO: 41, SEQ ID NO: 42, SEQ ID NO: 91, and SEQ ID NO: 92.

15. The fusion protein construct of claim 13, wherein the complement modulator polypeptide comprises an amino acid sequence selected from the group consisting of: SEQ ID NO: 41 and SEQ ID NO: 42.

16. The fusion protein construct of claim 1, wherein the antibody or antigen binding fragment thereof comprises:
   (a) a first heavy chain and a second heavy chain, wherein each of the first and the second heavy chain comprises three heavy chain complementarity determining regions (CDR-H1, CDR-H2, CDR-H3), wherein the CDR-H1 comprises the amino acid sequences of SEQ ID NO: 29, the CDR-H2 comprises the amino acid sequence of SEQ ID NO: 260, and the CDR-H3 comprises the amino acid sequence of SEQ ID NO: 31, and
   (b) a first light chain and second light chain, wherein each of the first and the second light chain comprises three light chain complementarity determining regions (CDR-L1, CDR-L2, CDR-L3), wherein the CDR-L1 comprises the amino acid sequence of SEQ ID NO: 32, the CDR-L2 comprises the amino acid sequence of SEQ ID NO: 33, and the CDR-L3 comprises the amino acid sequence of SEQ ID NO: 34.

17. The fusion protein construct of claim 16, wherein each of the first and the second heavy chain comprises a heavy chain variable region (HCVR) comprising the amino acid sequence of SEQ ID NO: 254, and wherein each of the first and the second light chain comprises a light chain variable region (LCVR) comprising the amino acid sequence of SEQ ID NO: 258.

18. The fusion protein construct of claim 17, wherein the first and the second heavy chain each comprises the amino acid sequence of the SEQ ID NO: 284, and wherein the first and the second light chain each comprises the amino acid sequence of SEQ ID NO: 279.

19. The fusion protein construct of claim 18, wherein the first and the second heavy chain each comprises the amino acid sequence of SEQ ID NO: 282.

20. The fusion protein construct of claim 18, wherein the first and the second heavy chain each comprises the amino acid sequence of SEQ ID NO: 285.

21. The fusion protein construct of claim 18, wherein the fusion protein further comprises a linker linking the antibody or antigen binding fragment thereof to one of the complement modulator polypeptides.

22. The fusion protein construct of claim 21, wherein the linker comprises the amino acid sequence selected from the group consisting of SEQ ID NO: 138SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, and SEQ ID NO: 241.

23. The fusion protein construct of claim 21, comprising:
  (c) a first linker bound to the C-terminus of the first heavy chain and comprising the amino acid sequence of SEQ ID NO: 138; and
  (d) a second linker bound to the C-terminus of the second heavy chain and comprising the amino acid sequence of SEQ ID NO: 138.

24. The fusion protein construct of claim 23, wherein the complement modulator polypeptide comprises an amino acid sequence selected from the group consisting of: SEQ ID NO: 41, SEQ ID NO: 42, SEQ ID NO: 91, and SEQ ID NO: 92.

25. The fusion protein construct of claim 1, wherein the fusion protein construct is selected from the group consisting of:
  (1) two heavy chain-containing polypeptides, each comprising, from N- to C-terminal, the amino acid sequence of SEQ ID NO: 282, the amino acid sequence of SEQ ID NO: 138, and the amino acid sequence of SEQ ID NO: 41; and, two light chain-containing polypeptides each comprising the amino acid sequence of SEQ ID NO: 279;
  (2) two heavy chain-containing polypeptides, each comprising, from N- to C-terminal, the amino acid sequence of SEQ ID NO: 285, the amino acid sequence of SEQ ID NO: 138, and the amino acid sequence of SEQ ID NO: 41; and, two light chain-containing polypeptides each comprising the amino acid sequence of SEQ ID NO: 279;
  (3) a heavy chain-containing polypeptide comprising, from N- to C-terminal, the amino acid sequence of SEQ ID NO: 284, the amino acid sequence of SEQ ID NO: 138, and the amino acid sequence of SEQ ID NO: 41; and, a light chain-containing polypeptide comprising, from N- to C-terminal, the amino acid sequence of SEQ ID NO: 279, the amino acid sequence of SEQ ID NO: 138, and the amino acid sequence of SEQ ID NO: 41;
  (4) a heavy chain-containing polypeptide comprising, from N- to C-terminal, the amino acid sequence of SEQ ID NO: 284, the amino acid sequence of SEQ ID NO: 138, and the amino acid sequence of SEQ ID NO: 41; and, a light chain comprising the amino acid sequence of SEQ ID NO: 279;
  (5) two heavy chain-containing polypeptides, each comprising, from N- to C-terminal, the amino acid sequence of SEQ ID NO: 282, the amino acid sequence of SEQ ID NO: 138, and the amino acid sequence of SEQ ID NO: 42; and, two light chain-containing polypeptides each comprising the amino acid sequence of SEQ ID NO: 279;
  (6) two heavy chain-containing polypeptides, each comprising, from N- to C-terminal, the amino acid sequence of SEQ ID NO: 285, the amino acid sequence of SEQ ID NO: 138, and the amino acid sequence of SEQ ID NO: 42; and, two light chain-containing polypeptides each comprising the amino acid sequence of SEQ ID NO: 279;
  (7) a heavy chain-containing polypeptide comprising, from N- to C-terminal the amino acid sequence of SEQ ID NO: 284, the amino acid sequence of SEQ ID NO: 138, and the amino acid sequence of SEQ ID NO: 42; and, a light chain-containing polypeptide comprising, from N- to C-terminal, the amino acid sequence of SEQ ID NO: 279, the amino acid sequence of SEQ ID NO: 138, and the amino acid sequence of SEQ ID NO: 42; and,
  (8) a heavy chain-containing polypeptide comprising, from N- to C-terminal, the amino acid sequence of SEQ ID NO: 284, the amino acid sequence of SEQ ID NO: 138, and the amino acid sequence of SEQ ID NO: 42; and, a light chain comprising the amino acid sequence of SEQ ID NO: 279.

26. An antibody or an antigen-binding fragment thereof comprising:
  a heavy chain comprising: three heavy chain complementarity determining regions (CDR-H1, CDR-H2, CDR-H3) comprising the following set of amino acid sequences: SEQ ID NOS: 29, 260 and 31, and
  a light chain comprising: three light chain complementarity determining regions (CDR-L1, CDR-L2, CDR-L3) comprising the following set of amino acid sequences: SEQ ID NOS: 32, 33 and 34.

27. The antibody or antigen-binding fragment thereof of claim 26, wherein
  (a) the heavy chain comprises a heavy chain variable region comprising the amino acid sequence of SEQ ID NO: 254; and
  (b) the light chain comprises a light chain variable region comprising the amino acid sequence of SEQ ID NO: 258.

28. The antibody or antigen-binding fragment thereof of claim 27, wherein the light chain comprises the amino acid sequence of SEQ ID NO: 279.

29. The antibody or antigen-binding fragment thereof of claim 28, wherein the heavy chain comprises the amino acid sequence of SEQ ID NO: 284.

30. The antibody or antigen-binding fragment thereof of claim 29, wherein the heavy chain comprises the amino acid sequence of SEQ ID NO: 282.

31. The antibody or antigen-binding fragment thereof of claim 29, wherein the heavy chain comprises the amino acid sequence of SEQ ID NO: 285.

32. A pharmaceutical composition comprising the fusion protein construct of claim 1.

33. The pharmaceutical composition of claim 32, comprising the fusion protein construct of claim 16.

34. The pharmaceutical composition of claim 32, comprising the fusion protein construct of claim 25.

35. A pharmaceutical composition comprising the antibody or antigen-binding fragment of claim 26.

\* \* \* \* \*